US006623741B1

(12) United States Patent
Antczak et al.

(10) Patent No.: US 6,623,741 B1
(45) Date of Patent: Sep. 23, 2003

(54) METHODS AND COMPOSITIONS FOR INHIBITION OF MEMBRANE FUSION-ASSOCIATED EVENTS INCLUDING RSV TRANSMISSION

(75) Inventors: James B. Antczak, Durham, NC (US); Mary K. Delmedico, Raleigh, NC (US); Joel B. Erickson, Durham, NC (US); Dennis M. Lambert, Durham, NC (US); Prakash Sista, Durham, NC (US)

(73) Assignee: Trimeris, Inc., Durham, NC (US)

( * ) Notice: Subject to any disclaimer, the term of this patent is extended or adjusted under 35 U.S.C. 154(b) by 0 days.

(21) Appl. No.: 09/515,965

(22) Filed: Feb. 29, 2000

(51) Int. Cl.$^7$ .............................................. A61K 39/155
(52) U.S. Cl. ..................................... 424/211.1; 530/324
(58) Field of Search ............................ 424/211.1, 186.1; 530/300, 324

(56) References Cited

U.S. PATENT DOCUMENTS

| | | | |
|---|---|---|---|
| 4,190,496 A | 2/1980 | Rubenstein et al. ............ 435/7 |
| 5,141,867 A | 8/1992 | Ivanoff et al. ............ 435/252.3 |
| 5,656,480 A | 8/1997 | Wild et al. ................... 435/325 |
| 6,013,263 A | * 1/2000 | Barney et al. ............ 424/212.1 |

FOREIGN PATENT DOCUMENTS

| | | |
|---|---|---|
| WO | WO 90/07119 | 6/1990 |
| WO | WO 91/09872 | 7/1991 |
| WO | WO 92/22654 | 12/1992 |
| WO | WO 94/02505 | 2/1994 |
| WO | WO 94/28920 | 11/1994 |
| WO | WO 96/19495 | 7/1996 |
| WO | WO 96/40945 | * 12/1996 |
| WO | WO 99/59615 | * 11/1999 |

OTHER PUBLICATIONS

Barin et al., 1985, "Virus Envelope Protein of HTLV–III Represents Major Target Antigen for Antibodies in AIDS Patients", Science 228:1094–1096.

Barnett SW, Murthy KK, Herndier BG, Levy JA, 1994, "An AIDS–like condition induced in baboons by HIV–2", Science. Oct. 28; 266(5185):642–646.

Barré–Sinoussi et al., 1983, Isolation of a T–Lymphotropic Retrovirus from a Patient at Risk for Acquired Immune Deficiency Syndrome (AIDS), Science 220:868–870.

Chen SS, 1994, "Functional Role of the Zipper Motif Region of Human Immunodeficiency Virus Type I Transmembrane Protein gp41", J. Virol. 68(3):2002–2010.

Clavel et al., 1986, "Isolation of a New Human Retrovirus from West African Patients with AIDS", Science 233:343–346.

Daar et al., 1990, "High Concentrations of Recombinant Soluble CD40 are Required to Neutralize Primary Human Immunodeficiency Virus Type 1 Isolates", Proc. Natl. Acad. Sci USA 87:6574–6579.

Dalgleish et al., 1984, "The CD4 (T4) Antigen is an Essential Component of the Receptor for the AIDS Retrovirus", Nature 312:763–767.

Erickson et al., 1990, "Design, Activity and 2.8 Å Crystal Structure of a C2 Symmetric Inhibitor Complexed to HIV–1 Protease", Science 249:527–533.

Gallo et al., 1984, "Frequent Detection and Isolation of Cytopathic Retroviruses (HTLV–III) from Patients with AIDS and at Risk for AIDS", Science 224:500–503.

Goff S, Traktman P, Baltimore D, 1981, "Isolation and properties of Moloney murine luekemia virus mutants: use of a rapid assay for release of virion reverse transcriptase", J Virol. Apr.; 38(1):239–48.

Guyader et al., 1987, "Genome Organization and Transactivation of the Human Immunodeficiency Virus Type 2", Nature 326:662–669.

Harmarskjöld and Rekosh, 1989, "The Molecular Biology of the Human Immunodeficiency Virus", Biochem. Biophys. Acta 989:269–280.

Kahn et al., 1990, "The Safety and Pharmacokinetics Recombinant Soluble CD4 (rCD4) in Subjects with the Acquired Immunodeficiency Syndrome (AIDS) and AIDS–Related Complex", Ann. Int. Med. 112:254–261.

Klatzmann et al., 1984, "T–Lymphocyte T4 Molecule Behaves as the Receptor for Human Retrovirus LAV", Nature 312:767–768.

Lam et al., 1991, "A New Type of Synthetic Peptide Library for Identifying Ligand–Binding Activity", Nature 354:82–84.

Lupas et al., 1991, "Predicting Coiled Coils from Protein Sequences", Science 252:1162–1165.

Maddon et al., 1986, "The T4 Gene Encodes the AIDS Virus Receptor and is Expressed in the Immune System and the Brain", Cell 47:333–348.

Malim et al., 1988, "Immunodeficiency Virus rev trans–Activator Modulates the Expression of the Viral Regulatory Genes", Nature 335:181–183.

(List continued on next page.)

*Primary Examiner*—Laurie Scheiner
*Assistant Examiner*—Jeffrey S. Parkin
(74) *Attorney, Agent, or Firm*—Pennie & Edmonds LLP

(57) ABSTRACT

The present invention relates to peptides which exhibit potent anti-retroviral activity. The peptides of the invention are derived from regions of viral fusion proteins referred to as HR1 and HR2. In particular, the invention relates to peptides referred to herein as DP107 and DP178 which comprise amino acid sequences corresponding to sequences found in the HR1 and HR2 regions, respectively of the HIV-1$_{LAI}$ gp41 protein. The invention further relates to "DP107-like" and "DP178-like" peptides that are derived from HR1 and HR2 regions, respectively, of other proteins, including DP107-like and DP178-like peptides derived from the HR1 and HR2 regions of the F1 subunit of the respiratory syncytial virus fusion protein.

12 Claims, 45 Drawing Sheets

OTHER PUBLICATIONS

Figure 2:
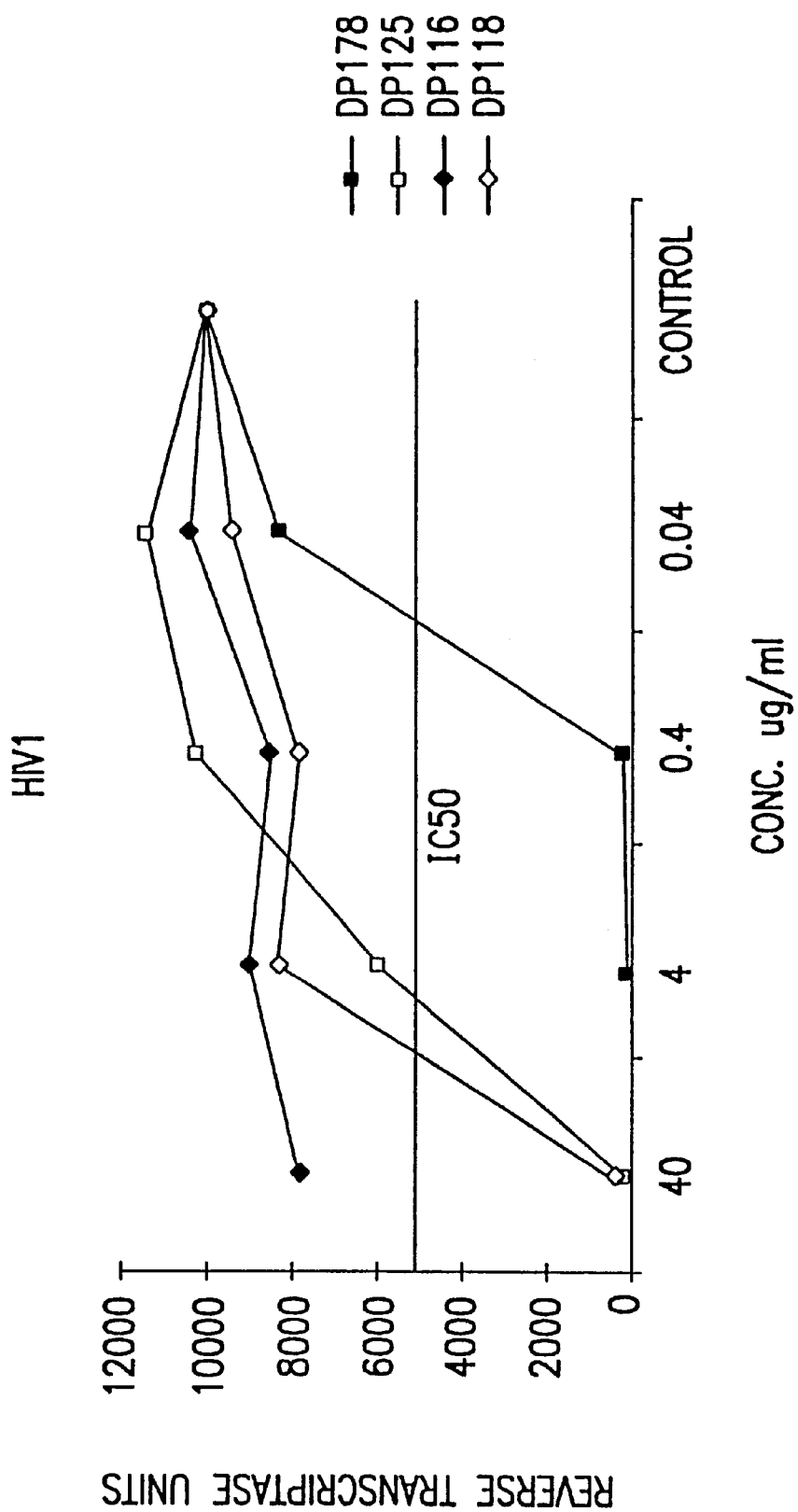

Matthews TJ, Weinhold KJ, Lyerly HK, Langlois AJ, Wigzell H, Bolognesi DP, 1987, "Interaction between the human T–cell lymphotropic virus type IIIB envelope glycoprotein gp120 and the surface antigen CD4: role of carbohydrate in binding and cell fusion", Proc Natl Acad Sci USA. Aug.; 84(15):5424–5428.

McDougal et al., 1986, "Binding of HTLV–III/LAV to T4+ T Cells by a Complex of the 110k Viral Protein and the T4 Molecule", Science 231:382–385.

Mitsuya et al., 1990, "Molecular Targets for AIDS Therapy", Science 249:1533–1544.

Mitsuya et al., 1991, "Targeted Therapy of Human Immunodeficiency Virus–Related Disease", FASEB J. 5:2369–2381.

Schooley et al., 1990, "Recombinant Soluble CD4 Therapy in Patients with the Acquired Immume Deficiency Syndrome (AIDS) and AIDS–Related Complex. A Phase I–II Escalating Dosage Trial", Ann. Int. Med. 112:247–253.

Smith et al., 1987, "Blocking of HIV–1 Infectivity by a Soluble, Secreted Form of the CD4 Antigen", Science 238:1704–1707.

Songyang et al., 1993, "SH2 Domains Recognize Specific Phosphopeptide Sequences", Cell 72:767–778.

Teich et al., 1984, "Pathogenesis of Lentivirus", in: RNA Tumor Viruses, Weiss et al., eds., CSH Press, pp. 949–956.

White, 1992, "Membrane Fusion", Science 258:917–924.

Wild et al., 1992, "A Synthetic Peptide Inhibitor of Human Immunodeficiency Virus Replication: Correlation between Solution Structure and Viral Inhibition", Proc. Natl. Acad. Sci USA 89:10537–10541.

Willey RL, Smith DH, Lasky LA, Theodore TS, Earl PL, Moss B, Capon DJ, Martin MA, 1988, "In vitro mutagenesis identifies a region within the envelope gene of the human immunodeficiency virus that is critical for infectivity", J. Virol. Jan.; 62(1):139–47.

Xu et al., 1991, "Epitope Mapping of Two Immunodominant Domains of gp41, the Transmembrane Protein of Human Immunodeficiency Virus Type 1, Using Ten Human Monoclonal Antibodies", J. Virol. 65:4832–4838.

Yarchoan et al., 1989, "Phase I Study of the Administration of Recombinant Soluble CD4 (rCD4) by Continuous Infusion to Patients with AIDS or ARC", Proc. Vth Int. Conf. on AIDS, p. 564, MCP 137.

* cited by examiner

```
HIV1LAI   (DP-178; SEQ ID NO:15)     YTSLIHSLIEESQNQQEKNEQELLELDKWASLWNWF
HIV1SF2   (DP-185; SEQ ID NO:1357)   YTNTIYTLLEESQNQQEKNEQELLELDKWASLWNWF
HIV1RF    (SEQ ID NO:1358)           YTGIIYNLLEESQNQQEKNEQELLELDKWANLWNWF
HIV1MN    (SEQ ID NO:1553)           YTSLIYSLLEKSQTQQEKNEQELLELDKWASLWNWF

HIV2ROD   (SEQ ID NO:1554)           LEANISKSLEQAQIQQEKNMYELQKLNSWDIFGNWF
HIV2NIHZ  (SEQ ID NO:1555)           LEANISQSLEQAQIQQEKNMYELQKLNSWDVFTNWL

DP180     (SEQ ID NO:55)             SSESFTLLEQWNNWKLQLAEQWLEQINEKHYLEDIS
DP118     (SEQ ID NO:904)            QQLLDVVKRQQEMLRLTVWGTKNLQARVTAIEKYLKDQ
DP125     (SEQ ID NO:496)            CGGNNLLRAIEAQQHLLQLTVWGIKQLQARILAVERYLKDQ
DP116     (SEQ ID NO:1552)                              LQARILAVERYLKDQQQ
```

FIG. 1

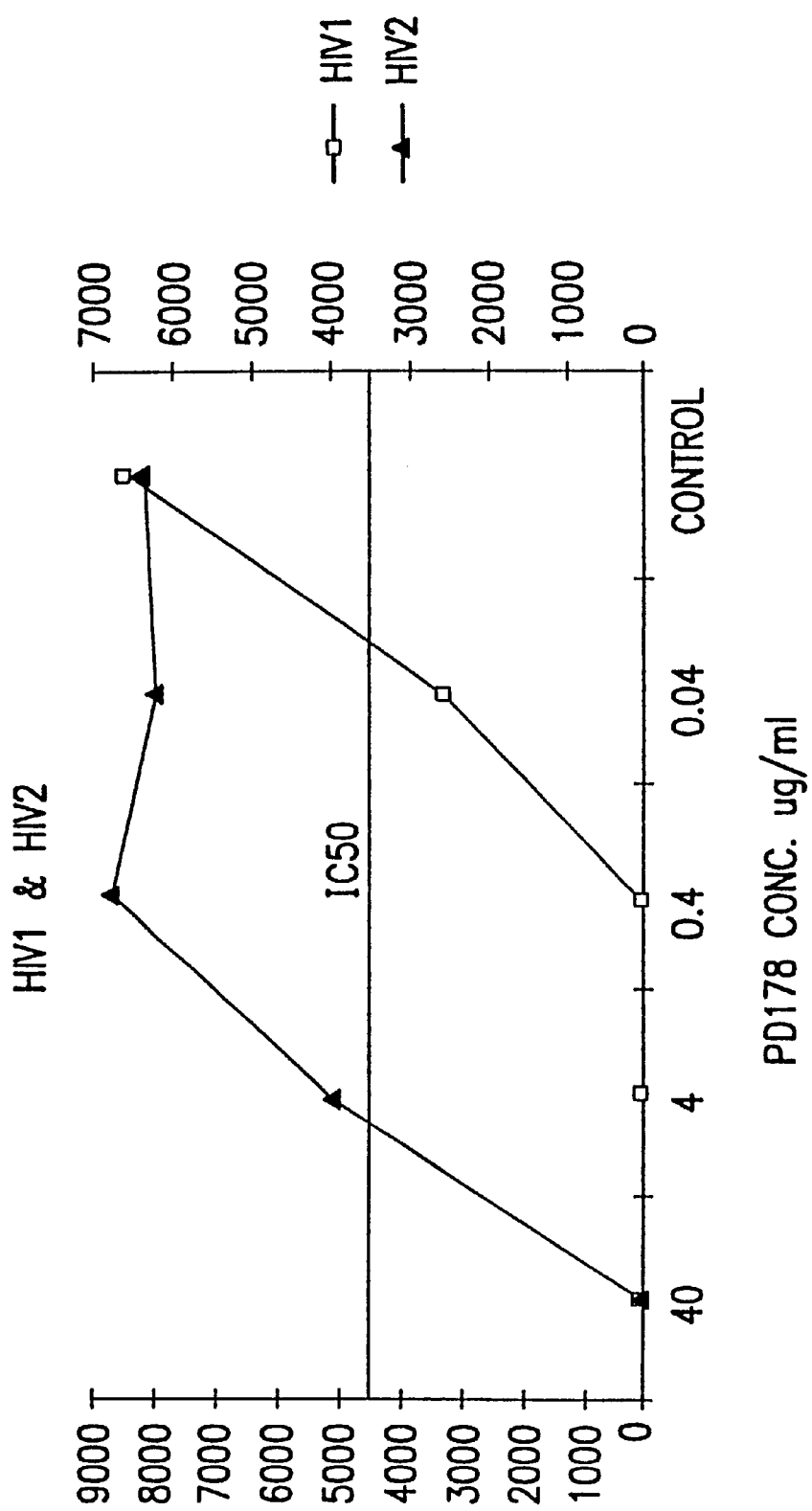

| Number of Syncytia/well: concentration in µg/ml (micrograms/ml) | | | | | | | | |
|---|---|---|---|---|---|---|---|---|
| DP178 | 10 | 5 | 1 | 0.2 | 0.1 | 0.05 | 0.025 | 0.0125 | Control |
| *Syncytia* | | | | | | | | |
| HIV1LAI | 0 | 0 | 0 | 0 | 0 | 0 | 0 | 0 | 67 |
| HIV1MN | 0 | 0 | 0 | 0 | 0 | ND | ND | ND | 34 |
| HIV1RF | 0 | 0 | 0 | 0 | 0 | ND | ND | ND | 65 |
| HIV1SF2 | 0 | 0 | 0 | 0 | 0 | ND | ND | ND | 58 |
| | | | | | | | | |
| DP125 | 10 | 5 | 1 | 0.2 | 0.1 | 0.05 | 0.025 | 0.0125 | Control |
| *Syncytia* | | | | | | | | |
| HIV1LAI | 0 | 0 | 54 | 69 | 80 | 75 | 79 | 82 | 67 |
| HIV1MN | 0 | 0 | 30 | 36 | ND | ND | ND | ND | 34 |
| HIV1RF | 0 | 0 | 67 | 63 | ND | ND | ND | ND | 65 |
| HIV1SF2 | 0 | 0 | 9 | 66 | ND | ND | ND | ND | 58 |
| | | | | | | | | |
| DP116 | 10 | 5 | 1 | 0.2 | 0.1 | 0.05 | 0.025 | 0.0125 | Control |
| *Syncytia* | | | | | | | | |
| HIV1LAI | 75 | ND | ND | ND | ND | ND | ND | ND | 67 |
| HIV1MN | 35 | ND | ND | ND | ND | ND | ND | ND | 34 |
| HIV1RF | 81 | ND | ND | ND | ND | ND | ND | ND | 65 |
| HIV1SF2 | 81 | ND | ND | ND | ND | ND | ND | ND | 58 |

FIG.4A

| DP180 | 40 | 20 | 10 | 5 | 2.5 | 1.25 | 0.625 | 0.3125 | Control |
|---|---|---|---|---|---|---|---|---|---|
| *Syncytia* | | | | | | | | | |
| HIV1LAI | 50 | >45 | >45 | >45 | >45 | >45 | >45 | >45 | 58 |
| | | | | | | | | | |
| DP185 | 40 | 20 | 10 | 5 | 2.5 | 1.25 | 0.625 | 0.3125 | Control |
| *Syncytia* | | | | | | | | | |
| HIV1LAI | 0 | 0 | 0 | 0 | 0 | 0 | 0 | ND | 60 |

FIG.4B

HIV1

Number of Syncytia/well: concentration in ng/ml (nanograms/ml)

| DP178 | 20 | 10 | 5 | 2.5 | 1.25 | 0.625 | 0.3125 | Control |
|---|---|---|---|---|---|---|---|---|
| Syncytia HIV1 | 0 | 0 | 0 | 0 | 0 | 14 | 20 | 48 |
| DP116 | 20 | 10 | 5 | 2.5 | 1.25 | 0.625 | 0.3125 | Control |
| Syncytia HIV1 | ND | 48 | ND | ND | ND | ND | ND | ND |

HIV2

Number of Syncytia/well: concentration in µg/ml (micrograms/ml)

| DP178 | 20 | 10 | 5 | 2.5 | 1.25 | 0.625 | 0.3125 | Control |
|---|---|---|---|---|---|---|---|---|
| Syncytia HIV2 | 50 | 54 | 55 | 57 | 63 | 77 | 78 | 76 |
| DP116 | 20 | 10 | 5 | 2.5 | 1.25 | 0.625 | 0.3125 | Control |
| Syncytia HIV2 | ND | 58 | ND | ND | ND | ND | ND | ND |

FIG.5

| Sequence | Positions | | | | | | | | | | | Motifs |
|---|---|---|---|---|---|---|---|---|---|---|---|---|
| | A | D | A | D | A | D | A | D | A | D | | |
| GCN4 (gcn4_yeast) | M | K Q L E D K | V E E L L S | K N Y H L E | N E V A R L | K K L | | | | | [LMNV] {CFGIMPTW} |
| C-FOS (fos_human) | T | D T L Q A E T D | Q L E D E K S | A L Q T E I | A N L L K E | | | | | | | [IKLT] {CFGHIMPRVWY} |
| C-JUN (tap1_human) | I | A R L E E K V K T | L L K A Q N S | E L A S T A N | M L R E Q | | | | | | | [AILNV] {CDFGHILPVWY} |
| C-MYC (myo_human) | E | Q K L I S E E D L | L R K R R E Q | L K H K L E Q | L R N S | | | | | | | [ELR] {ACFGMPVWY} |
| FLU LOOP 36 | I | E K T N E K F H Q | I E K E F S E | V E G R I Q D | D L E K Y | | |

FIG. 13

| Sequence | Positions (A D A D A D A D A D A D A) | Motifs |
|---|---|---|
| DP-107 (env_hv1bru) L1=D | N N L L R A I E A Q Q H L L Q L T V W G I K Q L Q A R I L | [ILQT] {CFIMPSTY} |
| DP-107 (env_hv1bru) L1=D | N N L L R A I E A Q Q H L L Q L T V W G I K Q L Q A R I L | [ILQTV] {CDFIMPST} |
| DP-107 (env_hv1bru) L1=D | N N L L R A I E A Q Q H L L Q L T V W G I K Q L Q A R I L | [ILQTV] {CDFIMPST} |
| DP-107 (env_hv1bru) L2=D | L L R A I E A Q Q H L L Q L T V W G I K Q L Q A R I L A V E R Y L K D Q | [EKLNQV] {CDFKMPSVY} |
| DP-107 (env_hv1bru) L2=D | L L R A I E A Q Q H L L Q L T V W G I K Q L Q A R I L A V E R Y L | [EKLNQV] {CFKMPS} |
| DP-107 (env_hv1bru) L2=D | L L R A I E A Q Q H L L Q L T V W G I K Q L Q A R I L A V E R Y L | [EKLNQV] {CFKMPS} |
| DP-178 (env_hv1bru) Y1=A | Y T S L I H S L I E E S Q N Q Q E K N E Q E L L E L D K W A S L W N W F | [EKLQY] {ACFGMPRVWY} |
| DP-178 (env_hv1bru) Y1=A | Y T S L I H S L I E E S Q N Q Q E K N E Q E L L E L D K W A S L W N W F | [EKLQWY] {CFGMPRVY} |
| DP-178 (env_hv1bru) Y1=A | Y T S L I H S L I E E S Q N Q Q E K N E Q E L L E L D K W A S L W N W F | [EFKLQWY] {CFGMPRVY} |
| DP-178 (env_hv1bru) Y1=D | Y T S L I H S L I E E S Q N Q Q E K N E Q E L L E L D K W A S L W N W | [EILNQSY] {ACFGMPRVWY} |
| DP-178 (env_hv1bru) Y1=D | Y T S L I H S L I E E S Q N Q Q E K N E Q E L L E L D K W A S L W N W | [EILNQSWY] {CFGMPRVY} |
| DP-178 (env_hv1bru) Y1=D | Y T S L I H S L I E E S Q N Q Q E K N E Q E L L E L D K W A S L W N W F | [EFILNQSWY] {CFGMPRVY} |

| Sequence | Positions | | | | | | | | | | | | | | | | | | | | | | | | | | Parent Motif | Hybrid Motif |
|---|---|---|---|---|---|---|---|---|---|---|---|---|---|---|---|---|---|---|---|---|---|---|---|---|---|---|---|---|
| | A | D | A | D | A | D | A | D | A | D | A | D | A | | | | | | | | | | | | | | | |
| GCN4 (gcn4_yeast) | M K | Q L E D | K V E | E L L S | K N Y H L | E N E V | A R L K K L | | | | | | | | | | | | | | | | | | | | [LMNV] {CFGIMPTW} | |
| DP-107 (env_hv1bru)L1=0 | N N | L L L R A | I E A | Q Q H L L | L Q L T V | W G I K | Q L Q A R I | | | | | | | | | | | | | | | | | | | | [ILQT] {CFIMPSTY} | [ILMNQTV] {CFIMPT} |
| DP-107 (env_hv1bru)L1=0 | N N | L L L R A | I E A | Q Q H L L | L Q L T V | W G I K | Q L Q A R I | | | | | | | | | | | | | | | | | | | | [ILQTV] {CDFIMPST} | [ILMNQTV] {CFIMPT} |
| DP-107 (env_hv1bru)L1=0 | N N | L L L R A | I E A | Q Q H L L | L Q L T V | W G I K | Q L Q A R I | L A V E R Y L | | | | | | | | | | | | | | | | | | | [ILQTV] {CDFIMPST} | [ILMNQTV] {CFIMPT} |
| DP-107 (env_hv1bru)L2=0 | N N | L L L R A | I E A | Q Q H L L | L Q L T V | W G I K | Q L Q A R I | L A V E R Y L | K D Q | | | | | | | | | | | | | | | | | | [EKLNQV] {CDFKMPSVY} | [EKLMNQV]

| Sequence | Positions | | | | | | | | | | | | | | | | | | | | | | | | | | | | | | | | | | | Parent Motif | Hybrid Motif |
|---|---|---|---|---|---|---|---|---|---|---|---|---|---|---|---|---|---|---|---|---|---|---|---|---|---|---|---|---|---|---|---|---|---|---|---|---|---|
| | A | D | | | | A | D | | | | A | D | | | | A | D | | | | A | D | | | | A | D | | | | A | D | | | | | |
| GCN4 (gcn4 yeast) | M K | Q L E D K | V E | E L L | S K N Y H | L E N E V | A R L K K L | | | | | | | | | | | | | | | | | | | | | | | | | | | | | [LMV] {CFGIMPTW} | |
| DP-178 (env_hv1bru)Y1=A | Y T | S L I | I H | S L I | E E S | Q N Q Q | E K N E Q | E L L | E L D K | | | | | | | | | | | | | | | | | | | | | | | | | | | [EKLQY] {ACFGM

FIG. 16

| Sequence | Positions | | | | | | | | | | | Parent Motif | Hybrid Motif |
|---|---|---|---|---|---|---|---|---|---|---|---|---|---|
| | A | D | A | D | A | D | A | D | A | D | A | D | |
| DP-107 (env_hv1bru)L1=D | I | N | L | R | A | I | E | A | Q | Q | H | L | [ILQTV] {CDFIMPST} | |
| DP-107 (env_hv1bru)L2=D | N | N

| Sequence | Positions | | | | | | | | | | | | | | | | | | | | Parent Motif | Hybrid Motif |
|---|---|---|---|---|---|---|---|---|---|---|---|---|---|---|---|---|---|---|---|---|---|---|
| | A | D | A | D | A | D | A | D | A | D | A | D | A | D | A | D | A | D | | | |
| GCN4 (gcn4 yeast) | M | K | Q | L | E | D | K | V | E | E | L | L | S | K | N | Y | H | L | E | N | [LMVV] {CFGIMPTW} | |
| DP-107 (env_hv1bru)L1=D | N | N | L | L | R | A | I | E | A | Q | Q | H | L | L | Q | L | T | V | W | G | [ILQTV] {CDFIMPST} | |
| DP-178 (env_hv1bru)Y1=A | Y | T | S | L | I | H | S | L | I | E | E | S | Q | N | Q | Q | E | K | N | E | [EFIKLQWY] {CFGMPRVY} | [EFIKLMNQTVWY] {CFMP} |
| GCN4 (gcn4 yeast) | M | K | Q | L | E | D | K | V | E | E | L | L | S | K | N | Y | H | L | E | N | [LMVV] {CFGIMPTW} | |
| DP-107 (env_hv1bru)L1=D | N | N | L | L | R | A | I | E | A | Q | Q | H | L | L | Q | L | T | V | W | G | [ILQTV] {CDFIMPST} | |
| DP-178 (env_hv1bru)Y1=D | | | Y | T | S | L | I | H | S | L | I | E | E | S | Q | N | Q | Q | E | K | [EFILNQSWY] {CFGMPRVY} | [EFILMNQRSTVWY] {CFMP} |
| GCN4 (gcn4 yeast) | M | K | Q | L | E | D | K | V | E | E | L | L | S | K | N | Y | H | L | E | N | [LMVV] {CFGIMPTW} | |
| DP-107 (env_hv1bru)L2=D | N | N | L | L | R | A | I | E | A | Q | Q | H | L | L | Q | L | T | V | W | G | [EKLNQV] {CFKMPS} | |
| DP-178 (env_hv1bru)Y1=A | Y | T | S | L | I | H | S | L | I | E | E | S | Q | N | Q | Q | E | K | N | E | [EFIKLQWY] {CFGMPRVY} | [EFKLMNQVWY] {CFMP} |
| GCN4 (gcn4 yeast) | M | K | Q | L | E | D | K | V | E | E | L | L | S | K | N | Y | H | L | E | N | [LMVV] {CFGIMPTW} | |
| DP-107 (env_hv1bru)L2=D | N | N | L | L | R | A | I | E | A | Q | Q | H | L | L | Q | L | T | V | W | G | [EKLNQV] {CFKMPS} | |
| DP-178 (env_hv1bru)Y1=D | | | Y | T | S | L | I | H | S | L | I | E | E | S | Q | N | Q | Q | E | K | [EFILNQSWY] {CFGMPRVY} | [EFIKLMNQSVWY] {CFMP} |

FIG. 17

| Sequence | Positions | | | | | | | | | Parent Motif | Hybrid Motif |
|---|---|---|---|---|---|---|---|---|---|---|---|
| | A | D | A | D | A | D | A | D | A | | |
| GCN4 (gcn4_yeast) | M K Q L E | D K V E E | L L S K N Y | H L E N E V | A R L K K L |   |   |   |   | [LMV] {CFGIMPTW} | |
| DP-107 (env_hv1bru)L1=D | N N L L R | A I E A Q Q | H L L Q L T | V W G I K Q | L Q A R I L | A V E R Y L K | D Q |   |   | [ILQTV] {CDFIMPST} | |
| DP-107 (env_hv1bru)L2=D | N N L L R | A I E A Q Q | H L L Q L T | V W G I K Q | L Q A R I L | A V E R Y L K | D Q |   |   | [EKLNQV] {CFKMPS} | |
| DP-178 (env_hv1bru)Y1=A | Y T S L I | H S L I E E | S Q N Q Q E | K N E Q E L | L E L D K W A | S L W N W F |   |   |

P-[LIV]-{P}(6)-[LIV]-{P}(6)-[LIV]
P-{P}(1)-[LIV]-{P}(6)-[LIV]-{P}(6)-[LIV]
P-{P}(2)-[LIV]-{P}(6)-[LIV]-{P}(6)-[LIV]
P-{P}(3)-[LIV]-{P}(6)-[LIV]-{P}(6)-[LIV]
P-{P}(4)-[LIV]-{P}(6)-[LIV]-{P}(6)-[LIV]
P-{P}(5)-[LIV]-{P}(6)-[LIV]-{P}(6)-[LIV]
P-{P}(6)-[LIV]-{P}(6)-[LIV]-{P}(6)-[LIV]
P-{P}(7)-[LIV]-{P}(6)-[LIV]-{P}(6)-[LIV]
P-{P}(8)-[LIV]-{P}(6)-[LIV]-{P}(6)-[LIV]
P-{P}(9)-[LIV]-{P}(6)-[LIV]-{P}(6)-[LIV]
P-{P}(10)-[LIV]-{P}(6)-[LIV]-{P}(6)-[LIV]
P-X(1,12)-[LIV]-{P}(6)-[LIV]-{P}(6)-[LIV]
P-X(13,23)-[LIV]-{P}(6)-[LIV]-{P}(6)-[LIV]

FIG.19

```
        Fusion      ▼ALLMOTI5▼
        Peptide              ♠107x178x4♠
▼.......FLGFL    LGVGSAIAS GVA  ♠YSKVLHL EGEVNKIKSA
```

```
                                            ♣P1&12LZIPC♣
LLSTNKAVVS LSNGVSVLTS KVLDLKNYID KQ♠▼ LL    ♣PIVNKQ
```

```
    ♠107x178x4♠
SC ♠SISNIETVI♠ EFQQKNNRLLEITREFSVNAG♠ VTTPVSTMLTNSELLSL
```

```
       ♣P1&12LZIPC♣
           ▼ALLMOTI5▼
INDM ♣PI ▼TNDQ KKLMSNNVQI V♣ RQQSYSI♣ MS IIKEEVLAYV
```

```
VQ▼ LPLYGVID TPCWKLHTSP LCTTNTKEGS NICLTRTDRG WYCDNAGSVS
```

```
FFPQAETCKV QSNRVFCDTM NSLTLPSEIN LCNVDIFNPK
```

```
YDCKIMTSKT DVSSSVITSL GAIVSCYGKT KCTASNKNRG
```

```
IIKTFSNGCDYVSNKGMDTV SVGNTLYYVN KQEGKSLYVK G
```

```
         ♣P7, 12, & 23LZIPC♣
           ♠107x178x4♠                   ▼ALLMOTI5▼
EPIINFYDPLVF ♣PSDE ♠FDASISQVNEKINQSLAF ▼I♣ RKSDELL♣
```

```
              ♦Transmembrane Region♦
IINVNA♠ GK STTN  ♦IMITTI IIVIIVILLS LIAVGLLLY▼ C♦
```

```
KARSTPVTLS KDQLSGINNI AFSN
```

FIG.20

| | | | | | | | | | | | | | | | | | | | | | |
|---|---|---|---|---|---|---|---|---|---|---|---|---|---|---|---|---|---|---|---|---|---|
| RSV F2 | Y | T | S | V | I | T | I | E | L | S | N | I | K | E | N | K | C | N | G | A | K |
| T-142 | Y | T | S | V | I | T | I | E | L | S | N | I | K | E | N | K | C | N | G | A | K |
| T-143 | | T | S | V | I | T | I | E | L | S | N | I | K | E | N | K | C | N | G | A | K |
| T-144 | | | S | V | I | T | I | E | L | S | N | I | K | E | N | K | C | N | G | A | K |
| T-145 | | | | V | I | T | I | E | L | S | N | I | K | E | N | K | C | N | G | A | K |
| T-146 | | | | | I | T | I | E | L | S | N | I | K | E | N | K | C | N | G | A | K |
| T-147 | | | | | | T | I | E | L | S | N | I | K | E | N | K | C | N | G | A | K |
| T-148 | | | | | | | I | E | L | S | N | I | K | E | N | K | C | N | G | A | K |
| T-149 | | | | | | | | E | L | S | N | I | K | E | N | K | C | N | G | A | K |
| T-150 | | | | | | | | | L | S | N | I | K | E | N | K | C | N | G | A | K |
| T-151 | | | | | | | | | | S | N | I | K | E | N | K | C | N | G | A | K |
| T-152 | | | | | | | | | | | N | I | K | E | N | K | C | N | G | A | K |
| T-153 | | | | | | | | | | | | I | K | E | N | K | C | N | G | A | K |
| T-154 | | | | | | | | | | | | | K | E | N | K | C | N | G | A | K |
| T-155 | | | | | | | | | | | | | | E | N | K | C | N | G | A | K |

| | | | | | | | | | | |
|---|---|---|---|---|---|---|---|---|---|---|
| RSV F2 | V | K | L | I | K | Q | E | L | D | K | Y | K | N | A | V | T | E | L | Q | L | L | M | Q | S | T |
| T-142 | V | K | L | I | K | Q | E | L | D | K | Y | K | | | | | | | | | | | | | |
| T-143 | V | K | L | I | K | Q | E | L | D | K | Y | K | N | | | | | | | | | | | | |
| T-144 | V | K | L | I | K | Q | E | L | D | K | Y | K | N | A | | | | | | | | | | | |
| T-145 | V | K | L | I | K | Q | E | L | D | K | Y | K | N | A | V | | | | | | | | | | |
| T-146 | V | K | L | I | K | Q | E | L | D | K | Y | K | N | A | V | T | | | | | | | | | |
| T-147 | V | K | L | I | K | Q | E | L | D | K | Y | K | N | A | V | T | E | | | | | | | | |
| T-148 | V | K | L | I | K | Q | E | L | D | K | Y | K | N | A | V | T | E | L | | | | | | | |
| T-149 | V | K | L | I | K | Q | E | L | D | K | Y | K | N | A | V | T | E | L | Q | | | | | | |
| T-150 | V | K | L | I | K | Q | E | L | D | K | Y | K | N | A | V | T | E | L | Q | L | | | | | |
| T-151 | V | K | L | I | K | Q | E | L | D | K | Y | K | N | A | V | T | E | L | Q | L | L | | | | |
| T-152 | V | K | L | I | K | Q | E | L | D | K | Y | K | N | A | V | T | E | L | Q | L | L | M | | | |
| T-153 | V | K | L | I | K | Q | E | L | D | K | Y | K | N | A | V | T | E | L | Q | L | L | M | Q | | |
| T-154 | V | K | L | I | K | Q | E | L | D | K | Y | K | N | A | V | T | E | L | Q | L | L | M | Q | S | |
| T-155 | V | K | L | I | K | Q | E | L | D | K | Y | K | N | A | V | T | E | L | Q | L | L | M | Q | S | T |

FIG.21A

| RSV F2 | AV | FUSION ARRAY PURIFIED IC50 (XTT) (µg/ml) | CD |
|---|---|---|---|
| T-142 | ++ | 39 | ++ |
| T-143 | ++ | 31 | +++ |
| T-144 | + | 114 | ++ |
| T-145 | ++ | 40 | + |
| T-146 | - | 281 | - |
| T-147 | - | 204 | - |
| T-148 | - | 354 | - |
| T-149 | - | 336 | - |
| T-150 | - | 342 | + |
| T-151 | +/- | 116 | + |
| T-152 | +/- | 117 | ++ |
| T-153 | - | 280 | + |
| T-154 | +/- | 118 | ++ |
| T-155 | - | 253 | + |

FIG. 21B

| RSV PEPTIDE # | Sequence | AVG. IC50 (XTT) UG/ML |
|---|---|---|
| T-22 | IELSNIKENKCNGTDAKVKLIKQELDKYKNAVTELQLLMQST | >500 |
| T-23 | IELSNIKENKCNGTDAKVKLIKQELDKY | >500 |
| T-24 | ENKCNGTDAKVKLIKQELDKYKNAVTEL | >500 |
| T-25 | DAKVKLIKQELDKYKNAVTELQLLMQST | >500 |
| T-26 | CNGTDAKVKLIKQELDKYKNAVTELQLL | >500 |
| T-27 | SNIKENKCNGTDAKVKLIKQELDKYKNAVTELQLL | >500 |
| T-68 | VSKGYSALRTGWYTSVITIELSNIKEN | 165 |
| T-334 | AFIRKSDELLHNV | 26 |
| T-371 | YTSVITIELSNIKENKUNGTDAKVKLIKQELDKYK | >500 |
| T-372 | TSVITIELSNIKENKUNGTDAKVKLIKQELDKYKN | NOT TESTED |
| T-373 | SVITIELSNIKENKUNGTDAKVKLIKQELDKYKNA | >500 |
| T-374 | SNIKENKUNGTDAKVKLIKQELDKYKNAVTELQLL | >500 |
| T-375 | KENKUNGTDAKVKLIKQELDKYKNAVTELQLLMQS | >500 |
| T-575 | AVSKGYLSALRTGWYTSVITIELSNIKENKUNGTDA | >100 |

FIG. 21C

FIG.21D

| RSV | FUSION ASSAY | | |
|---|---|---|---|
| | AV | PURIFIED IC50 XTT (µg/ml) | CD |
| F-107 | – | 204 | – |
| T-120 | – | 354 | – |
| T-121 | – | 347 | – |
| T-122 | +/– | 126 | – |
| T-123 | + | 95 | – |
| T-124 | + | 84 | – |
| T-125 | + | 89 | – |
| T-126 | – | 89 | – |
| T-127 | – | 206 | – |
| T-128 | – | 343 | – |
| T-129 | +/– | 177 | – |
| T-130 | – | 118 | – |
| T-131 | +/– | 272 | – |
| T-132 | +/– | 307 | – |
| T-133 | + | 187 | – |
| T-134 | – | 60 | – |
| T-135 | + | 194 | – |
| T-136 | ++ | 99 | – |
| T-137 | + | 38 | – |
| T-138 | – | 86 | +/– |
| T-139 | – | 160 | +/– |
| T-140 | – | 204 | +/– |

FIG.21E

| RSV Peptide # | Sequence | AVG. IC50 (XTT) µg/ml |
|---|---|---|
| T-12 | VVSLSNGVSVLTSKVLDLKNYIDKQLL | >500 |
| T-13 | AVVSLSNGVSVLTSKVLDLKNY | >500 |
| T-15 | VLHLEGEVNKIKSALLSTNKAVVSLSNG | >500 |
| T-19 | LLSTNKAVVSLSNGVSVLTSKVLDLKNY | >500 |
| T-28 | ASGVAVSKVLHLEGEVNKIKSALLSTNKAVVSLSNGV | >500 |
| T-29 | SGVAVSKVLHLEGEVNKIKSALLSTNKAVVSLSNG | 327 |
| T-30 | VLHLEGEVNKIKSALLSTNKAVVSLSNGVSVLTSK | 328 |
| T-69 | VVSLSNGVSVLTSKVLDLKNYIDKQLL | 292 |
| T-70 | VNKIKSALLSTNKAVVSLSNGVSVLTSK | 349 |
| T-66 | NDQKKLMSNNVQIVRQQSYSIMSIIKEE | >500 |
| T-576 | SIISNIETVIEFQQKNNRLLEITREFSVNAGVTTPVS | >100 |

FIG.21F

RSV DP-178-LIKE REGION (F1)

| | | |
|---|---|---|
| RSV | | |
| T-67 | | DEFDASISQVNEKINQSLAFIRKSDELL |
| F1-178 | | GEPIINFYDPLVFPSDEFDASISQVNEKINQSLAFIRKSDELLHNVNAGKSTT |
| T-104 | | IINFYDPLVFPSDEFDASISQVNEKINQSLAFIRK |
| T-105 | | INFYDPLVFPSDEFDASISQVNEKINQSLAFIRKS |
| T-106 | | NFYDPLVFPSDEFDASISQVNEKINQSLAFIRKSD |
| T-107 | | FYDPLVFPSDEFDASISQVNEKINQSLAFIRKSDE |
| T-108 | | YDPLVFPSDEFDASISQVNEKINQSLAFIRKSDEL |
| T-109 | | DPLVFPSDEFDASISQVNEKINQSLAFIRKSDELL |
| T-110 | | PLVFPSDEFDASISQVNEKINQSLAFIRKSDELLH |
| T-111 | | LVFPSDEFDASISQVNEKINQSLAFIRKSDELLHN |
| T-112 | | VFPSDEFDASISQVNEKINQSLAFIRKSDELLHNV |
| T-113 | | FPSDEFDASISQVNEKINQSLAFIRKSDELLHNVN |
| T-114 | | PSDEFDASISQVNEKINQSLAFIRKSDELLHNVNA |
| T-115 | | SDEFDASISQVNEKINQSLAFIRKSDELLHNVNAG |
| T-116 | (T-67-LIKE) | DEFDASISQVNEKINQSLAFIRKSDELLHNVNAGK |
| T-117 | | EFDASISQVNEKINQSLAFIRKSDELLHNVNAGKS |
| T-118 | | FDASISQVNEKINQSLAFIRKSDELLHNVNAGKST |
| T-119 | | DASISQVNEKINQSLAFIRKSDELLHNVNAGKSTT |

FIG.22A

| | | | |
|---|---|---|---|
| | | FUSION ASSAY | |
| | | PURIFIED | |
| | | IC50 | |
| RSV | AV | (μg/ml) (XTT) | CD |
| T-67 | ++ | 37 | +/- |
| F1-178 | | | |
| T-104 | + | 95 | |
| T-105 | + | 86 | |
| T-106 | - | 186 | |
| T-107 | ++ | 20 | |
| T-108 | +++ | 6 | |
| T-109 | +++ | 8 | |
| T-110 | ++ | 30 | |
| T-111 | +++ | 9 | |
| T-112 | +++ | 8 | +/- |
| T-113 | +++ | 6 | +/- |
| T-114 | +++ | 5 | +/- |
| T-115 | +++ | 6 | +/- |
| T-116 | +++ | 9 | +/- |
| T-117 | +++ | 14 | +/- |
| T-118 | +++ | 5 | +/- |
| T-119 | +++ | 6 | +/- |
| | | | |
| | | | |
| | | | |
| | | | |

FIG.22B

| RSV | | | | | | | | | | | | | | | | | | | | | | | | | | | | | | | | | | | | | | AVG. IC50 |
|---|---|---|---|---|---|---|---|---|---|---|---|---|---|---|---|---|---|---|---|---|---|---|---|---|---|---|---|---|---|---|---|---|---|---|---|---|---|---|
| PEPTIDE# | | | | | | | | | | | | | | | | | | | | | | | | | | | | | | | | | | | | | | (XTT)ug/ml |
| T-71 | P | I | I | N | F | Y | D | P | L | V | F | P | S | D | E | F | D | A | S | I | S | Q | V | N | E | K | I | N | Q | S | L | A | F | I | R | | | 138 |
| T-384 | R | M | K | Q | L | E | D | K | V | E | E | L | L | S | K | L | A | F | I | R | K | S | D | E | L | L | H | N | V | | | | | | | | | NOT TESTED |
| T-613 | | | | | | | | | | | D | E | L | L | H | N | V | N | A | G | K | S | T | | | | | | | | | | | | | | | >100 |
| T-614 | | | | | | | | | K | S | D | E | L | L | H | N | V | N | A | G | K | S | T | | | | | | | | | | | | | | | >100 |
| T-615 | | | | | | | I | R | K | S | D | E | L | L | H | N | V | N | A | G | K | S | T | | | | | | | | | | | | | | | >100 |
| T-616 | | | | | A | F | I | R | K | S | D | E | L | L | H | N | V | N | A | G | K | S | T | | | | | | | | | | | | | | | >100 |
| | | | | | | | | | | | | | | | | | | | | | | | | | | | | | | | | | | | | | | |
| T-617 | F | D | A | S | I | S | Q | V | N | E | K | I | N | Q | S | L | A | F | I | | | | | | | | | | | | | | | | | | | NOT TESTED |
| | | | | | | | | | | | | | | | | | | | | | | | | | | | | | | | | | | | | | | |
| T-662 | S | L | A | F | I | R | K | S | D | E | L | L | H | N | V | N | A | G | K | S | T | | | | | | | | | | | | | | | | | >100 |
| | | | | | | | | | | | | | | | | | | | | | | | | | | | | | | | | | | | | | | |
| T-663 | F | D | A | S | I | S | Q | V | N | E | K | I | N | Q | S | L | A | F | I | R | K | | | | | | | | | | | | | | | | | NOT TESTED |
| T-665 | F | D | A | S | I | S | Q | V | N | E | K | I | N | Q | S | L | A | F | I | R | K | S | D | E | L | L | H | N | V | N | A | G | K | | | | | 7 |
| T-666 | F | D | A | S | I | S | Q | V | N | E | K | I | N | Q | S | L | A | F | I | R | K | S | D | E | L | L | H | N | V | N | A | | | | | | | 4 |
| T-667 | F | D | A | S | I | S | Q | V | N | E | K | I | N | Q | S | L | A | F | I | R | K | S | D | E | L | L | H | N | V | | | | | | | | | 4 |
| T-668 | F | D | A | S | I | S | Q | V | N | E | K | I | N | Q | S | L | A | F | I | R | K | S | D | E | L | L | H | | | | | | | | | | | 5 |
| T-669 | F | D | A | S | I | S | Q | V | N | E | K | I | N | Q | S | L | A | F | I | R | K | S | D | E | L | | | | | | | | | | | | | 80 |
| T-670 | F | D | A | S | I | S | Q | V | N | E | K | I | N | Q | S | L | A | F | I | R | K | S | D | | | | | | | | | | | | | | | >100 |
| | | | | | | | | | | | | | | | | | | | | | | | | | | | | | | | | | | | | | | |
| T-671 | A | S | I | S | Q | V | N | E | K | I | N | Q | S | L | A | F | I | R | K | S | D | E | L | L | H | N | V | N | A | G | K | S | T | | | | | 8 |
| T-672 | | | I | S | Q | V | N | E | K | I | N | Q | S | L | A | F | I | R | K | S | D | E | L | L | H | N | V | N | A | G | K | S | T | | | | | 6 |
| T-673 | | | | | Q | V | N | E | K | I | N | Q | S | L | A | F | I | R | K | S | D | E | L | L | H | N | V | N | A | G | K | S | T | | | | | 14 |
| T-674 | | | | | | | N | E | K | I | N | Q | S | L | A | F | I | R | K | S | D | E | L | L | H | N | V | N | A | G | K | S | T | | | | | >100 |
| T-675 | | | | | | | | | K | I | N | Q | S | L | A | F | I | R | K | S | D | E | L | L | H | N | V | N | A | G | K | S | T | | | | | >100 |
| T-676 | | | | | | | | | | | N | Q | S | L | A | F | I | R | K | S | D | E | L | L | H | N | V | N | A | G | K | S | T | | | | | >100 |
| | | | | | | | | | | | | | | | | | | | | | | | | | | | | | | | | | | | | | | |
| T-730 | F | D | A | S | I | S | Q | V | N | E | K | I | N | Q | S | L | A | F | I | R | K | S | D | E | L | L | H | N | V | N | A | G | K | S | T | | | NOT TESTED |

FIG.22C

|       |                                                      | FUSION IC50 μg/ml | T888 IC50 Conc.(nM) |
|-------|------------------------------------------------------|-------------------|---------------------|
| T112  | Ac-VFPSDEFDASISQVNEKINQSLAFIRKSDELLHNV-NH2           | .030              | 1                   |
| T800  | Ac-AAASDEFDASISQVNEKINQSLAFIRKSDELLHNV-NH2       | 2.6               | 6.4                 |
| T801  | Ac-VFPAAAFDASISQVNEKINQSLAFIRKSDELLHNV-NH2       | 1.7               | INSOLUBLE           |
| T802  | Ac-VFPSDEAAASISQVNEKINQSLAFIRKSDELLHNV-NH2       | 3                 | 75.6                |
| T803  | Ac-VFPSDEFDAAAAQVNEKINQSLAFIRKSDELLHNV-NH2       | 2.1               | 7.3                 |
| T804  | Ac-VFPSDEFDASISAAAEKINQSLAFIRKSDELLHNV-NH2       | 1.3               | 28.7                |
| T805  | Ac-VFPSDEFDASISQVNAAANQSLAFIRKSDELLHNV-NH2       | 2.1               |                     |
| T806  | Ac-VFPSDEFDASISQVNEKIAAALAFIRKSDELLHNV-NH2       | 0.9               | 3.5                 |
| T807  | Ac-VFPSDEFDASISQVNEKINQSAAAIRKSDELLHNV-NH2       | 0.5               | 195                 |
| T808  | Ac-VFPSDEFDASISQVNEKINQSLAFAAASDELLHNV-NH2       | 0.5               | 7.2                 |
| T809  | Ac-VFPSDEFDASISQVNEKINQSLAFIRKAAALLHNV-NH2       | 3.8               | INSOLUBLE           |
| T810  | Ac-VFPSDEFDASISQVNEKINQSLAFIRKSDEAAANV-NH2       | 1.3               | 624                 |
| T811  | Ac-VFPSDEFDASISQVNEKINQSLAFIRKSDELLAAA-NH2       | 1.6               | 4.8                 |
|       |                                                      |                   |                     |
| T1669 | Ac-VFPSDEADASISQVNEKINQSLAFIRKSDELLHNV-NH2       |                   |                     |
| T1670 | Ac-VFPSDEFAASISQVNEKINQSLAFIRKSDELLHNV-NH2       |                   |                     |
| T1671 | Ac-VFPSDEFDASISAVNEKINQSLAFIRKSDELLHNV-NH2       |                   |                     |
| T1672 | Ac-VFPSDEFDASISQANEKINQSLAFIRKSDELLHNV-NH2       |                   |                     |
| T1673 | Ac-VFPSDEFDASISQVAEKINQSLAFIRKSDELLHNV-NH2       |                   |                     |
| T1680 | Ac-VFPSDEFDASISQVNEKINQSAAFIRKSDELLHNV-NH2       |                   |                     |
| T1681 | Ac-VFPSDEFDASISQVNEKINQSLAAIRKSDELLHNV-NH2       |                   |                     |
| T1682 | Ac-VFPSDEFDASISQVNEKINQSLAFIRKSDEALHNV-NH2       |                   |                     |
| T1683 | Ac-VFPSDEFDASISQVNEKINQSLAFIRKSDELAHNV-NH2       |                   |                     |
| T1684 | Ac-VFPSDEFDASISQVNEKINQSLAFIRKSDELLANV-NH2       |                   |                     |

FIG.23

| | | DOES SUBSTITUTION PREVENT CD INTERACTION? | FUSION IC50 (ng/ml) | T83 ELARA (Biot-T20) IC50 Conc. (nM) | T1342 FP (Fluo-T20) IC50 Conc. (nM) |
|---|---|---|---|---|---|
| T20 | Ac-YTSLIHSLIEESQNQQEKNEQELLELDKWASLWNWF-NH2 | Native | 2 | 69 | |
| T813 | Ac-*AAAA*IHSLIEESQNQQEKNEQELLELDKWASLWNWF-NH2 | | 3 | 1000 | |
| T878 | Ac-YTS***AAA***SLIEESQNQQEKNEQELLELDKWASLWNWF-NH2 | Reduced | 37 | 1000 | |
| T877 | Ac-YTSLIH***AAA***EESQNQQEKNEQELLELDKWASLWNWF-NH2 | Inhibited | 1757 | Neg | |
| T876 | Ac-YTSLIHSLIAAAQNQQEKNEQELLELDKWASLWNWF-NH2 | Native | 11 | 29 | |
| T875 | Ac-YTSLIHSLIEES***AAA***QEKNEQELLELDKWASLWNWF-NH2 | Inhibited | 33 | >3000 | |
| T874 | Ac-YTSLIHSLIEESQNQ***AAA***NEQELLELDKWASLWNWF-NH2 | Inhibited | 545 | >3000 | |
| T873 | Ac-YTSLIHSLIEESQNQQEK***AAA***ELLELDKWASLWNWF-NH2 | Inhibited | 814 | Neg | |
| T872 | Ac-YTSLIHSLIEESQNQQEKNEQAAAELDKWASLWNWF-NH2 | Native | 23 | 66 | |
| T871 | Ac-YTSLIHSLIEESQNQQEKNEQELL***AAA***KWASLWNWF-NH2 | Inhibited | 89 | 1156 | |
| T870 | Ac-YTSLIHSLIEESQNQQEKNEQELLELD***AAA***SLWNWF-NH2 | Reduced | 8 | 251 | |
| T869 | Ac-YTSLIHSLIEESQNQQEKNEQELLELDKWAAAANWF-NH2 | Reduced | 28 | 57 | |
| T868 | Ac-YTSLIHSLIEESQNQQEKNEQELLELDKWASLWAAA-NH2 | Reduced | 56 | 56 | |

FIG.24A

| | | | | |
|---|---|---|---|---|
| T1663 | Ac-ATSLIHSLIEESQNQQEKNEQELLELDKWASLWNWF-NH2 | Native | | |
| T1664 | Ac-YASLIHSLIEESQNQQEKNEQELLELDKWASLWNWF-NH2 | Native | | |
| T1665 | Ac-YTALIHSLIEESQNQQEKNEQELLELDKWASLWNWF-NH2 | Native | | |
| T1660 | Ac-YTSAIHSLIEESQNQQEKNEQELLELDKWASLWNWF-NH2 | Reduced | | |
| T1661 | Ac-YTSLAHSLIEESQNQQEKNEQELLELDKWASLWNWF-NH2 | Reduced | | |
| T1662 | Ac-YTSLIASLIEESQNQQEKNEQELLELDKWASLWNWF-NH2 | Native | | |
| T1656 | Ac-YTSLIHALIEESQNQQEKNEQELLELDKWASLWNWF-NH2 | Native | | |
| T1657 | Ac-YTSLIHSAIEESQNQQEKNEQELLELDKWASLWNWF-NH2 | Reduced | 60 | |
| T1659 | Ac-YTSLIHSLAEESQNQQEKNEQELLELDKWASLWNWF-NH2 | Inhibited | | |
| T1653 | Ac-YTSLIHSLIEESANQQEKNEQELLELDKWASLWNWF-NH2 | Native | 1000 | |
| T1654 | Ac-YTSLIHSLIEESQAQQEKNEQELLELDKWASLWNWF-NH2 | Native | 14 | |
| T1655 | Ac-YTSLIHSLIEESQNAQEKNEQELLELDKWASLWNWF-NH2 | Inhibited | 40 | |
| T1650 | Ac-YTSLIHSLIEESQNQAEKNEQELLELDKWASLWNWF-NH2 | Inhibited | >1000 | |
| T1651 | Ac-YTSLIHSLIEESQNQQEANEQELLELDKWASLWNWF-NH2 | Native | 200 | |
| T1652 | Ac-YTSLIHSLIEESQNQQEKAEQELLELDKWASLWNWF-NH2 | Native | 27 | |
| T1630 | Ac-YTSLIHSLIEESQNQQEKNAQELLELDKWASLWNWF-NH2 | Inhibited | 27 | |
| T1631 | Ac-YTSLIHSLIEESQNQQEKNEAELLELDKWASLWNWF-NH2 | Reduced | 250 | |
| T1632 | Ac-YTSLIHSLIEESQNQQEKNEQELLALDKWASLWNWF-NH2 | Native | 53 | |
| T1627 | Ac-YTSLIHSLIEESQNQQEKNEQELLEADKWASLWNWF-NH2 | Native | | |
| T1628 | Ac-YTSLIHSLIEESQNQQEKNEQELLELAKWASLWNWF-NH2 | Reduced | | |
| T1629 | Ac-YTSLIHSLIEESQNQQEKNEQELLELAAWASLWNWF-NH2 | Native | | |

FIG.24B

F2 Domain:

Signal Peptidase Cleavage Site
↓

*mellilkana ittiltavtf cfa*SGQNITE EFYQSTCSAV SKGYLSALRT GWYTSVITIE 60

LSNIKENKCN GTDAKVKLIK QELDKYKNAV TELQLLMQST PPTNNRARRE LPRFMNYTLN 120

NAKKTNVTLS KKRKRR 136

F1 Domain:

(MF9.1)↓                         ↓(MF8.1) ↓(MF13)

*flgf*ILGVGS AIASGVAVS*K* VLHLEGEVNK IKSALLSTNK AVVSLSNGV*S* VLTSKVL*D*LK 196

↓(MF12)↓(MF7.1)    ↓(MF11)      ↓(MF10)

NYIDK*Q*LLPI V*V*KQSCSISN IETVIEF*QQ*K NNRLLEITRE FSV*V*AGVTTP VSTYMLTNSE 256

↓(MF6.1)                        ↓(MF5.1)

LLSLIN*D*MPI TNDQKKLMSN NVQIVRQQSY SIMSIIKEEV LAYVV*Q*LPLY GVIDTPCWKL 316

HTSPLCTTNT KEGSNICLTR TDRGWYCDNA GSVSFFPQAE TCKVQSNRVF CDTMNSLTLP 376

SEINLCNVDI FNPKYDCKIM TSKTDVSSSV ITSLGAIVSC YGKTKCTASN KNRGIIKTFS 436

↓(MF4.1)
NGCDYVSNKG MDTVSVGNTL YYVNKQEGKS LYVKGEPIIN FYDPLVFP*SD* EFDASISQVN 496

EKINQSLAFI RKSDELLHNV NAGKSTTNIM ITTIIIVIIV ILLSLIAVGL LLYCKARSTP 556
                                                   transmembrane anchor

VTLSKDQLSG INNIAFSN 574

FIG.25

| PEPTIDE NUMBER | IC50 ug/ml | LENGTH |
|---|---|---|
| T1536 | 23 | 35 |
| T1590 |  | 43 |
| T1585 | 58 | 44 |
| T1582 | 20 | 45 |
| T1581 | 3.36 | 46 |
| T1583 | 1.09 | 48 |
| T1772 |  | 50 |
| T1584 | 0.23 | 51 |
| T1623 | 0.80 | 54 |

| SEQUENCES | | | | | | | | | | | | | | | | | | | | | | | |
|---|---|---|---|---|---|---|---|---|---|---|---|---|---|---|---|---|---|---|---|---|---|---|---|
|  |  |  |  | V | L | H | L | E | G | E | V | N | K | I | K | S | A | L | L | S | T | N | K |
|  |  |  |  | V | L | H | L | E | G | E | V | N | K | I | K | S | A | L | L | S | T | N | K |
|  |  |  |  | V | L | H | L | E | G | E | V | N | K | I | K | S | A | L | L | S | T | N | K |
|  |  |  |  | V | L | H | L | E | G | E | V | N | K | I | K | S | A | L | L | S | T | N | K |
|  |  |  |  | V | L | H | L | E | G | E | V | N | K | I | K | S | A | L | L | S | T | N | K |
|  |  |  | S | K | V | L | H | L | E | G | E | V | N | K | I | K | S | A | L | L | S | T | N | K |
|  | A | V | S | K | V | L | H | L | E | G | E | V | N | K | I | K | S | A | L | L | S | T | N | K |
|  | A | V | S | K | V | L | H | L | E | G | E | V | N | K | I | K | S | A | L | L | S | T | N | K |
| S | G | V | A | V | S | K | V | L | H | L | E | G | E | V | N | K | I | K | S | A | L | L | S | T | N | K |

(sequences continue: K A V V S L S N G V S V L T S K V L D L K N Y I D K Q L for each row)

FIG.28 dam US 6,623,741 B1

METHODS AND COMPOSITIONS FOR INHIBITION OF MEMBRANE FUSION-ASSOCIATED EVENTS INCLUDING RSV TRANSMISSION

1. FIELD OF THE INVENTION

The present invention relates to peptides derived from protein regions or domains referred to herein as heptad repeat regions. In particular, the invention relates to a peptide referred to herein as DP178 or, alternatively, as T20. DP178 corresponds to amino acid residues 638 to 673 of the HIV-$1_{LAI}$ transmembrane protein (TM) gp41 which correspond to a heptad repeat region referred to as HR2. The invention also relates to portions or analogs of DP178 which exhibit anti-membrane fusion capability, antiviral activity (for example the ability to inhibit HIV transmission to uninfected CD4$^+$ cells) and/or an ability to modulate intracellular processes involving coiled-coil peptide structures.

The present invention also releates to a peptide referred to herein as DP107 or, alternatively, as T21. DP107 corresponds to amino acid residues 558 to 595 of the HIV-$1_{LAI}$ transmembrane protein gp41 which correspond to a heptad region referred to as HR1. The invention also relates to portions or analogs of DP107 which exhibit anti-membrane fusion capability, antiviral activity (for example the ability to inhibit HIV transmission to uninfected CD4$^+$ cells) and/or an ability to modulate intracellular process involving coiled-coil peptide structures.

The invention further relates to other DP178-like and DP107-like peptides derived, e.g., from other species of virus, and which correspond to HR1 and HR2 regions analogous to the HR1 and HR2 regions of the HIV-1 transmembrane protein gp41. Such peptides include, e.g., peptides derived from amino acid sequences of HR1 and HR2 regions of the respiratory syncytial virus (RSV) F1 fusion protein (F1-protein) which are described herein.

As described herein, the HR1 and HR2 regions of proteins such as HIV gp41 and the RSV F1-protein interact (non-covalently) with each other and/or with peptides derived therefrom (such as T20 and T21). This interaction is required for normal infectivity of viruses such as RSV and HIV.

The present invention therefore additionally relates to methods for identifying compounds, including small molecule compounds, that disrupt the interaction between DP178 and DP107 and/or between DP107-like and DP178-like peptides. In one embodiment, such methods relate to identification and utilization of modified DP178, DP178-like, DP107 and DP107-like peptides and peptide pairs that interact with each other at a lower affinity than the affinity exhibited by corresponding "parent" or "native" peptides. Further, the invention relates to the use of DP178, DP178 portions, DP107, DP107 portions and/or analogs and other modulators, including small molecule modulators, of DP178/DP107, DP178-like/DP107-like or HR1/HR2 interactions as antifusogenic or antiviral compounds or as inhibitors of intracellular events involving coiled-coil peptide structures.

The invention is demonstrated, first, by way of an Example, wherein DP178 and a peptide whose sequence is homologous to DP178 are each shown to be potent, non-cytotoxic inhibitors of HIV-1 transfer to uninfected CD4$^+$ cells. The invention is further demonstrated by Examples wherein peptides having structural and/or amino acid motif similarity to DP107 and DP178 are identified in a variety of viral and nonviral organisms, including RSV, and in Examples wherein a number of such identified peptides derived from several different viral systems are demonstrated to exhibit antiviral activity. The invention is still further demonstrated by way of other Examples wherein other DP178-like and DP107-like peptides are identified that interact with their corresponding HR1 and HR2 domains with a lower affinity than the affinity exhibited by the native DP178 or DP107 peptide from which they are derived. The invention is still further demonstrated by way of an additional Example wherein DP178-like and DP107-like peptides from the RSV F1-protein are identified and structural studies are carried out demonstrating that these peptides associate non-covalently to form the coiled-coil structure typical of an HR1/HR2 interaction.

2. BACKGROUND OF THE INVENTION

2.1. Membrane Fusion Events

Membrane fusion is a ubiquitous cell biological process (for a review, see White, J. M., 1992, Science 258:917–924). Fusion events which mediate cellular housekeeping functions, such as endocytosis, constitutive secretion, and recycling of membrane components, occur continuously in all eukaryotic cells.

Additional fusion events occur in specialized cells. Intracellularly, for example, fusion events are involved in such processes as occur in regulated exocytosis of hormones, enzymes and neurotransmitters. Intercellularly, such fusion events feature prominently in, for example, sperm-egg fusion and myoblast fusion.

Fusion events are also associated with disease states. For example, fusion events are involved in the formation of giant cells during inflammatory reactions, the entry of all enveloped viruses into cells, and, in the case of human immunodeficiency virus (HIV), for example, are responsible for the virally induced cell-cell fusion which leads to cell death.

2.2. The Human Immunodeficiency Virus

The human immunodeficiency virus (HIV) has been implicated as the primary cause of the slowly degenerative immune system disease termed acquired immune deficiency syndrome (AIDS) (Barre-Sinoussi, F. et al., 1983, Science 220:868–870; Gallo, R. et al., 1984, Science 224:500–503). There are at least two distinct types of HIV: HIV-1 (Barre-Sinoussi, F. et al., 1983, Science 220:868–870; Gallo R. et al., 1984, Science 224:500–503) and HIV-2 (Clavel, F. et al., 1986, Science 233:343–346; Guyader, M. et al., 1987, Nature 326:662–669). Further, a large amount of genetic heterogeneity exists within populations of each of these types. Infection of human CD-4$^+$ T-lymphocytes with an HIV virus leads to depletion of the cell type and eventually to opportunistic infections, neurological dysfunctions, neoplastic growth, and ultimately death.

HIV is a member of the lentivirus family of retroviruses (Teich, N. et al., 1984, RNA Tumor Viruses, Weiss, R. et al., eds., CSH-Press, pp. 949–956). Retroviruses are small enveloped viruses that contain a diploid, single-stranded RNA genome, and replicate via a DNA intermediate produced by a virally-encoded reverse transcriptase, an RNA-dependent DNA polymerase (Varmus, H., 1988, Science 240:1427–1439). Other retroviruses include, for example, oncogenic viruses such as human T-cell leukemia viruses (HTLV-I,-II,-III), and feline leukemia virus.

The HIV viral particle consists of a viral core, composed of capsid proteins, that contains the viral RNA genome and those enzymes required for early replicative events. Myristylated Gag protein forms an outer viral shell around the viral core, which is, in turn, surrounded by a lipid membrane enveloped derived from the infected cell membrane. The HIV enveloped surface glycoproteins are synthesized as a single 160 Kd precursor protein which is cleaved by a cellular protease during viral budding into two glycoproteins, gp41 and gp120. gp41 is a transmembrane protein and gp120 is an extracellular protein which remains non-covalently associated with gp41, possibly in a trimeric or multimeric form (Hammarskjold, M. and Rekosh, D., 1989, Biochem. Biophys. Acta 989:269–280).

HIV is targeted to CD-4$^+$ cells because the CD-4 cell surface protein acts as the cellular receptor for the HIV-1 virus (Dalgleish, A. et al., 1984, Nature 312:763–767; Klatzmann et al., 1984, Nature 312:767–768; Maddon et al., 1986, Cell 47:333–348). Viral entry into cells is dependent upon gp120 binding the cellular CD-4$^+$ receptor molecules (McDougal, J. S. et al., 1986, Science 231:382–385; Maddon, P. J. et al., 1986, Cell 47:333–348) and thus explains HIV's tropism for CD-4$^+$ cells, while gp41 anchors the enveloped glycoprotein complex in the viral membrane.

2.3. HIV Treatment

HIV infection is pandemic and HIV associated diseases represent a major world health problem. Although considerable effort is being put into the successful design of effective therapeutics, currently no curative anti-retroviral drugs against AIDS exist. In attempts to develop such drugs, several stages of the HIV life cycle have been considered as targets for therapeutic intervention (Mitsuya, H. et al., 1991, FASEB J. 5:2369–2381). For example, virally encoded reverse transcriptase has been one focus of drug development. A number of reverse-transcriptase-targeted drugs, including 2',3'-dideoxynucleoside analogs such as AZT, ddI, ddC, and d4T have been developed which have been shown to been active against HIV (Mitsuya, H. et al., 1991, Science 249:1533–1544). While beneficial, these nucleoside analogs are not curative, probably due to the rapid appearance of drug resistant HIV mutants (Lander, B. et al., 1989, Science 243:1731–1734). In addition, the drugs often exhibit toxic side effects such as bone marrow suppression, vomiting, and liver function abnormalities.

Attempts are also being made to develop drugs which can inhibit viral entry into the cell, the earliest stage of HIV infection. Here, the focus has thus far been on CD4, the cell surface receptor for HIV. Recombinant soluble CD4, for example, has been shown to inhibit infection of CD-4$^+$ T-cells by some HIV-1 strains (Smith, D. H. et al., 1987, Science 238:1704–1707). Certain primary HIV-1 isolates, however, are relatively less sensitive to inhibition by recombinant CD-4 (Daar, E. et al., 1990, Proc. Natl. Acad. Sci. USA 87:6574–6579). In addition, recombinant soluble CD-4 clinical trials have produced inconclusive results (Schooley, R. et al., 1990, Ann. Int. Med. 112:247–253; Kahn, J. O. et al., 1990, Ann. Int. Med. 112:254–261; Yarchoan, R. et al., 1989, Proc. Vth Int. Conf. on AIDS, p. 564, MCP 137).

The late stages of HIV replication, which involve crucial virus-specific secondary processing of certain viral proteins, have also been suggested as possible anti-HIV drug targets. Late stage processing is dependent on the activity of a viral protease, and drugs are being developed which inhibit this protease (Erickson, J., 1990, Science 249:527–533). The clinical outcome of these candidate drugs is still in question.

Attention is also being given to the development of vaccines for the treatment of HIV infection. The HIV-1 enveloped proteins (gp160, gp120, gp41) have been shown to be the major antigens for anti-HIV antibodies present in AIDS patients (Barin, et al., 1985, Science 228:1094–1096). Thus far, therefore, these proteins seem to be the most promising candidates to act as antigens for anti-HIV vaccine development. To this end, several groups have begun to use various portions of gp160, gp120, and/or gp41 as immunogenic targets for the host immune system. See for example, Ivanoff, L. et al., U.S. Pat. No. 5,141,867; Saith, G. et al., WO 92/22,654; Shafferman, A., WO 91/09,872; Formoso, C. et al., WO 90/07,119. Clinical results concerning these candidate vaccines, however, still remain far in the future.

Thus, although a great deal of effort is being directed to the design and testing of anti-retroviral drugs, a truly effective, non-toxic treatment is still needed.

3. SUMMARY OF THE INVENTION

The present invention relates, first, to DP178, a 36-amino acid synthetic peptide, also referred to herein as T20, corresponding to amino acids 638 to 673 of the transmembrane protein (TM) gp41 from the HIV-1 isolate LAI (HIV-1$_{LAI}$), which exhibits potent anti-HIV-1 activity. The gp41 region from which DP178 is derived is referred to herein as HR2.

The invention further relates to those portions and analogs of DP178 which also show such antiviral activity, and/or show anti-membrane fusion capability, or an ability to modulate intracellular processes involving coiled-coil peptide structures. The term "DP178 analog" refers to a peptide which contains an amino acid sequence corresponding to the DP178 peptide sequence present within the gp41 protein of HIV-1$_{LAI}$, but found in viruses and/or organisms other than HIV-1$_{LAI}$. Such DP178 analog peptides may, therefore, correspond to DP178-like amino acid sequences present in other viruses, such as, for example, enveloped viruses, such as RSV and other retroviruses other than HIV-1$_{LAI}$, as well as non-enveloped viruses. Further, such analogous DP178 peptides may also correspond to DP178-like amino acid sequences present in nonviral organisms. For ease of discussion, the regions of other proteins (i.e., proteins from viruses and/or organisms other than HIV-1$_{LAI}$) from which such DP178 analog peptides are derived are referred to herein as "HR2 regions."

The invention further relates to DP107, a peptide, which is also referred to herein as T21, corresponding to amino acids 558–595 of the HIV-1$_{LAI}$ transmembrane protein (TM) gp41. The gp41 region from which DP107 is derived is referred to herein as HR1. The invention also relates to those portions and analogs of DP107 which that also show antiviral activity, and/or show anti-membrane fusion capability, or an ability to modulate intracellular processes involving coiled-coil peptide structures. The term "DP107 analog" as used herein refers to a peptide which contains an amino acid sequence corresponding to the DP107 peptide sequence present within the gp41 protein of HIV-1$_{LAI}$, but found in viruses and organisms other than HIV-1$_{LAI}$. Such DP107 analog peptides may, therefore, correspond to DP107-like amino acid sequences present in other viruses, such as, for for example, enveloped viruses, such as retroviruses other than HIV-1$_{LAI}$, as well as non-enveloped viruses. Further, such DP107 analog peptides may also correspond to DP107-like amino acid sequences present in nonviral organisms. For ease of discussion, the regions of other proteins (i.e., proteins from viruses and/or organisms other than HIV-1$_{LAI}$) from which such DP107 analog peptides are derived are referred to herein as "HR1 regions."

Further, the peptides of the invention include DP107 analog and DP178 analog peptides having amino acid sequences of HR1 and HR2 domains, respectively, from other proteins such as from other viral proteins. Such "DP107-like" and "DP178-like" are readily recognized or identified by the 107×178×4, ALLMOTI5 and/or PLZIP search motifs described herein.

The peptides of the invention may, for example, exhibit antifusogenic activity, antiviral activity, and/or may have the ability to modulate intracellular processes which involve coiled-coil peptide structures. With respect to the antiviral activity of the peptides of the invention, such an antiviral activity includes, but is not limited to the inhibition of HIV transmission to uninfected CD-4⁺ cells. Additionally, the antifusogenic capability, antiviral activity or intracellular modulatory activity of the peptides of the invention merely requires the presence of the peptides of the invention, and, specifically, does not require the stimulation of a host immune response directed against such peptides.

The peptides of the invention may be used, for example, as inhibitors of membrane fusion-asociated events, such as, for example, the inhibition of human and non-human retroviral, especially HIV, transmission to uninfected cells. It is further contemplated that the peptides of the invention may be used as modulators of intracellular events involving coiled-coil peptide structures.

The peptides of the invention may, alternatively, be used to identify compounds, including small molecule compounds, which may themselves exhibit antifusogenic, antiviral, or intracellular modulatory activity. Additional uses include, for example, the use of the peptides of the invention as organism or viral type and/or subtype-specific diagnostic tools.

The terms "antifusogenic" and "anti-membrane fusion", as used herein, refer to an agent's ability to inhibit or reduce the level of membrane fusion events between two or more moieties relative to the level of membrane fusion which occurs between said moieties in the absence of the peptide. The moieties may be, for example, cell membranes or viral structures, such as viral envelopes or pili. The term "antiviral", as used herein, refers to the compound's ability to inhibit viral infection of cells, via, for example, cell-cell fusion or free virus infection. Such infection may involve membrane fusion, as occurs in the case of enveloped viruses, or some other fusion event involving a viral structure and a cellular structure (e.g., such as the fusion of a viral pilus and bacterial membrane during bacterial conjugation). It is also contemplated that the peptides of the invention may exhibit the ability to modulate intracellular events involving coiled-coil peptide structures. "Modulate", as used herein, refers to a stimulatory or inhibitory effect on the intracellular process of interest relative to the level or activity of such a process in the absence of a peptide of the invention.

Embodiments of the invention are demonstrated below wherein an extremely low concentration of DP178 (SEQ ID NO:15), and very low concentrations of a DP178 homolog (SEQ ID NO:1357) are shown to be potent inhibitors of HIV-1 mediated CD-4⁺ cell-cell fusion (i.e., syncytium formation) and infection of CD-4⁺ cells by cell-free virus. Further, it is shown that DP178 (SEQ ID NO:15) is not toxic to cells, even at concentrations 3 logs higher than the inhibitory DP-178 (SEQ ID NO:15) concentration.

The present invention is based, in part, on the surprising discovery that the DP107 and DP178 domains (i.e., the HR1 and HR2 domains) of the HIV gp41 protein non-covalently complex with each other, and that their interaction is required for the normal infectivity of the virus. This discovery is described in the Example presented, below, in Section 8. The invention, therefore, further relates to methods for identifying antifusogenic, including antiviral, compounds that disrupt the interaction between DP107 and DP178, and/or between DP107-like and DP178-like peptides.

Additional embodiments of the invention (specifically, the Examples presented in Sections 9 and 10, below) are demonstrated, below, wherein peptides having structural and/or amino acid motif similarity to DP107 and DP178 are identified from a variety of sources, and search motifs for their identification are described. Further, Examples (e.g., in Section 11) are presented wherein a number of the peptides of the invention are demonstrated exhibit substantial antiviral activity or activity predictive of antiviral activity. Further still, an additional example is presented, in Section 14, wherein additional DP107-like and DP178-like peptides are identified that correspond to HR1 and HR2 domains of the respiratory syncytial virus (RSV) F1-protein and are demonstrated to have properties characteristic of the DP107-like and DP178-like peptides of the invention. In particular, the peptides described in Section 14, below, are shown to associate non-covalently in solution to form a coiled-coil structure characteristic of HR1/HR2 interactions, and are also shown to be potent inhibitors of RSV infection.

Definitions:

Peptides are defined herein as organic compounds comprising two or more amino acids covalently joined by peptide bonds. Peptides may be referred to with respect to the number of constituent amino acids, i.e., a dipeptide contains two amino acid residues, a tripeptide contains three, etc. Peptides containing ten or fewer amino acids may be referred to as oligopeptides, while those with more than ten amino acid residues are polypeptides. Such peptides may also include any of the modifications and additional amino and carboxy groups as are described herein.

Peptide sequences defined herein are represented by one-letter symbols for amino acid residues as follows:

A (alanine)
R (arginine)
N (asparagine)
D (aspartic acid)
C (cysteine)
Q (glutamine)
E (glutamic acid)
G (glycine)
H (histidine)
I (isoleucine)
L (leucine)
K (lysine)
M (methionine)
F (phenylalanine)
P (proline)
S (serine)
T (threonine)
W (tryptophan)
Y (tyrosine)
V (valine)

4. BRIEF DESCRIPTION OF THE FIGURES

FIG. 1: Amino acid sequence of DP178 (SEQ ID NO:15) derived from $HIV_{LAI}$; DP178 homologs derived from HIV-$1_{SF2}$ (DP-185; SEQ ID NO:1357), HIV-$1_{RF}$ (SEQ ID NO:1358), and HIV-$1_{MN}$ (SEQ ID NO:1553); DP178 homologs derived from amino acid sequences of two prototypic HIV-2 isolates, namely, HIV-2$_{rod}$, (SEQ ID NO:1554) and HIV-2$_{NIHZ}$ (SEQ ID NO:1555); control peptides: DP-180 (SEQ ID NO:55), a peptide incorporating the amino acid residues of DP178 in a scrambled sequence; DP-118 (SEQ ID NO:904) unrelated to DP178, which inhibits HIV-1 cell free virus infection; DP-125 (SEQ ID NO:496), unrelated to DP178, also inhibits HIV-1 cell free virus infection; DP-116 (SEQ ID NO:1552), unrelated to DP178, is negative for inhibition of HIV-1 infection when tested using a cell-free virus infection assay. Throughout the figures, the one-letter amino acid code is used.

FIG. 2. Inhibition of HIV-1 cell-free virus infection by synthetic peptides. IC$_{50}$ refers to the concentration of peptide that inhibits RT production from infected cells by 50% compared to the untreated control. Control: the level of RT produced by untreated cell cultures infected with the same level of virus as treated cultures.

FIG. 3: Inhibition of HIV-1 and HIV-2 cell-free virus infection by the synthetic peptide DP178 (SEQ ID NO:15). IC$_{50}$: concentration of peptide that inhibits RT production by 50% compared to the untreated control. Control: Level of RT produced by untreated cell cultures infected with the same level of virus as treated cultures.

FIGS. 4A–4B: Fusion Inhibition Assays. FIG. 4A: DP178 (SEQ ID NO:15) inhibition of HIV-1 prototypic isolate-mediated syncytia formation; data represents the number of virus-induced syncytia per cell. FIG. 4B: DP-180 (SEQ ID NO:55) represents a scrambled control peptide; DP-185 (SEQ ID NO:1357) represents a DP178 homolog derived from HIV-1$_{SF2}$ isolate; Control, refers to the number of syncytia produced in the absence of peptide.

FIG. 5. Fusion inhibition assay: HIV-1 vs. HIV-2. Data represents the number of virus-induced syncytial per well. ND: not done.

Figure 6:
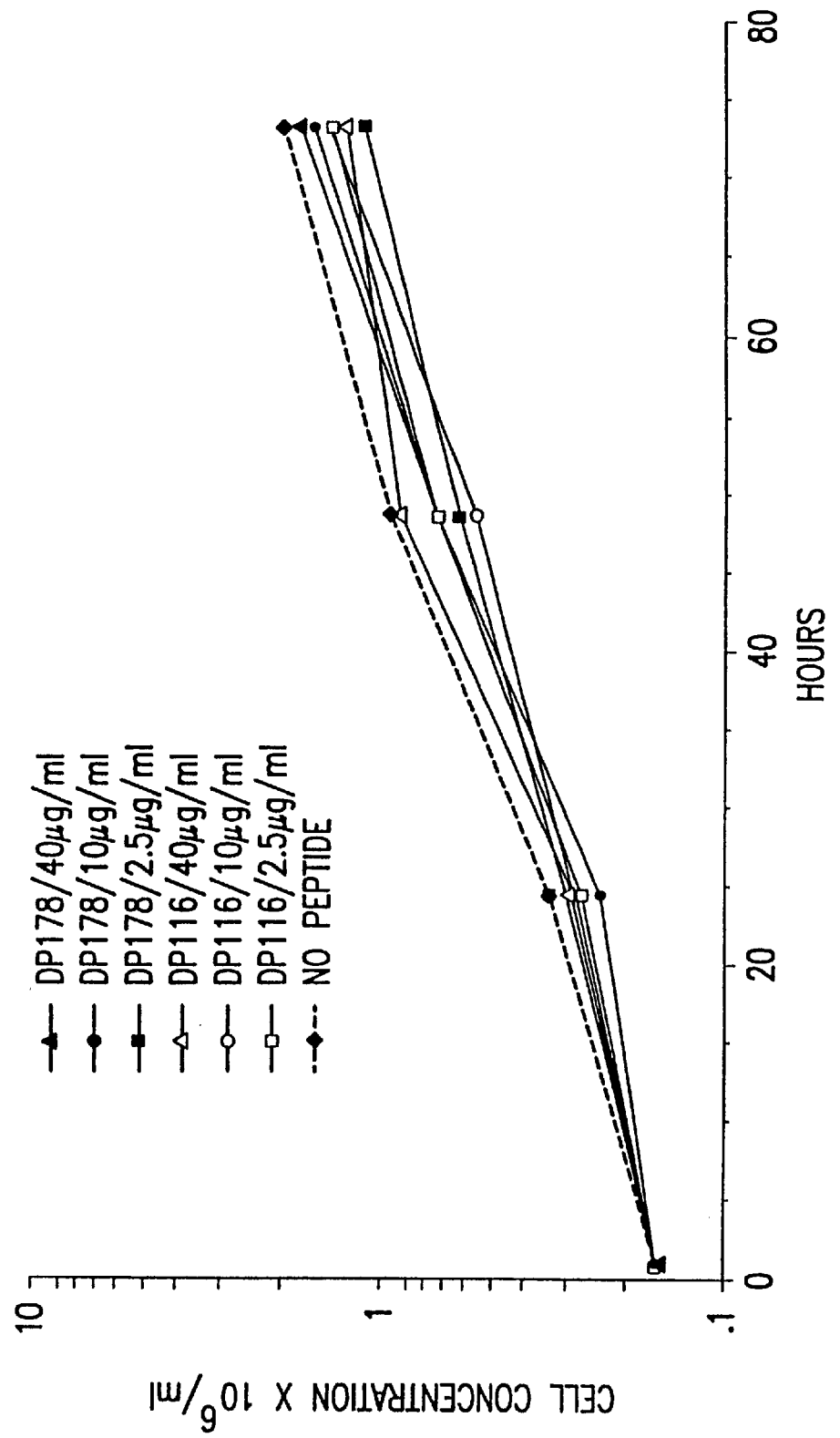

FIG. 6: Cytotoxicity study of DP178 (SEQ ID NO:15) and DP-116 (SEQ ID NO:1552) on CEM cells. Cell proliferation data is shown.

Figure 7:
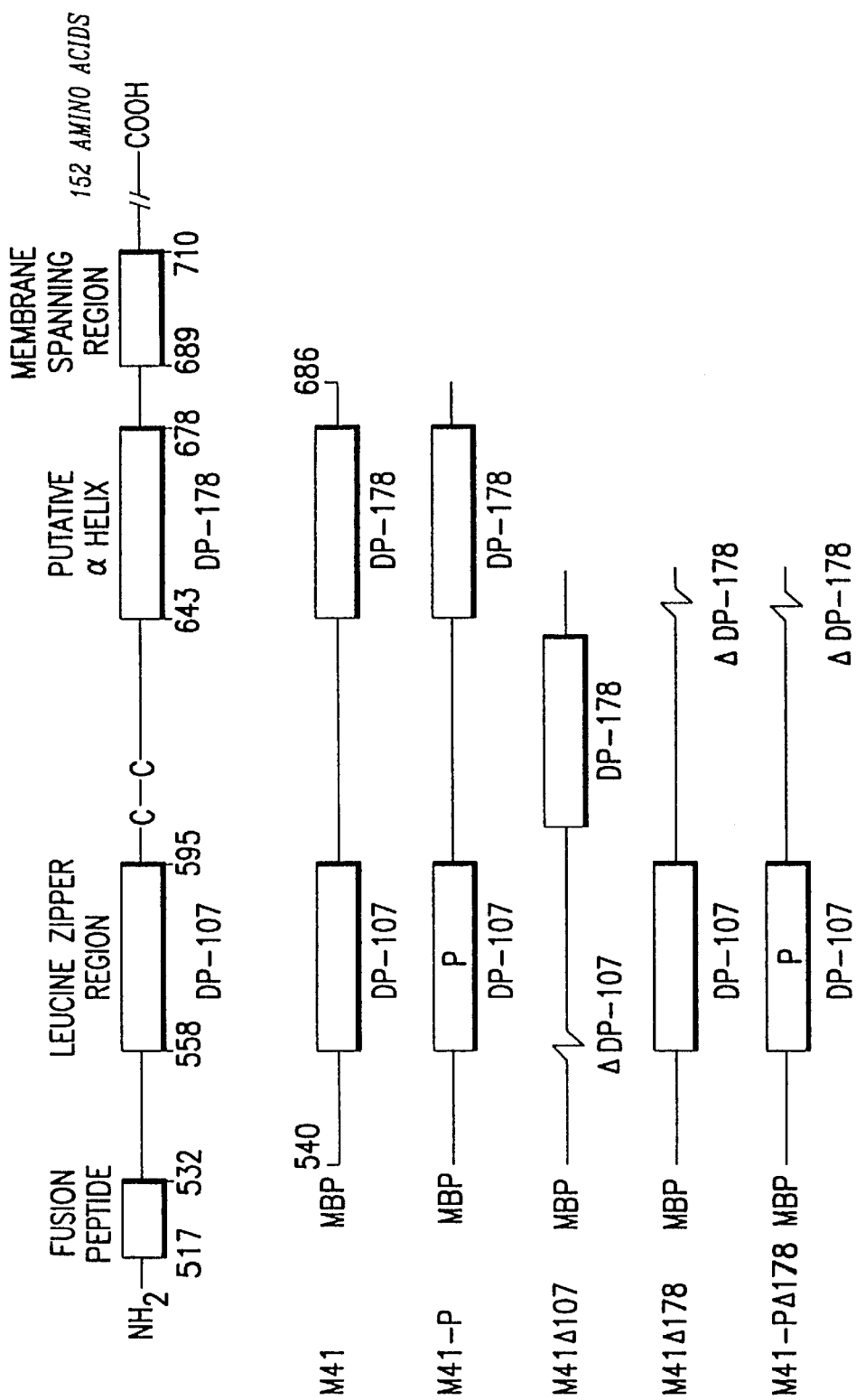

FIG. 7. Schematic representation of HIV-gp41 and maltose binding protein (MBP)-gp41 fusion proteins. DP107 and DP178 are synthetic peptides based on the two putative helices of gp41. The letter P in the DP107 boxes denotes an Ile to Pro mutation at amino acid number 578. Amino acid residues are numbered according to Meyers et al., "Human Retroviruses and AIDS", 1991, Theoret. Biol. and Biophys. Group, Los Alamos Natl. Lab., Los Alamos, N.Mex. The proteins are more fully described, below, in Section 8.1.1.

Figure 8:
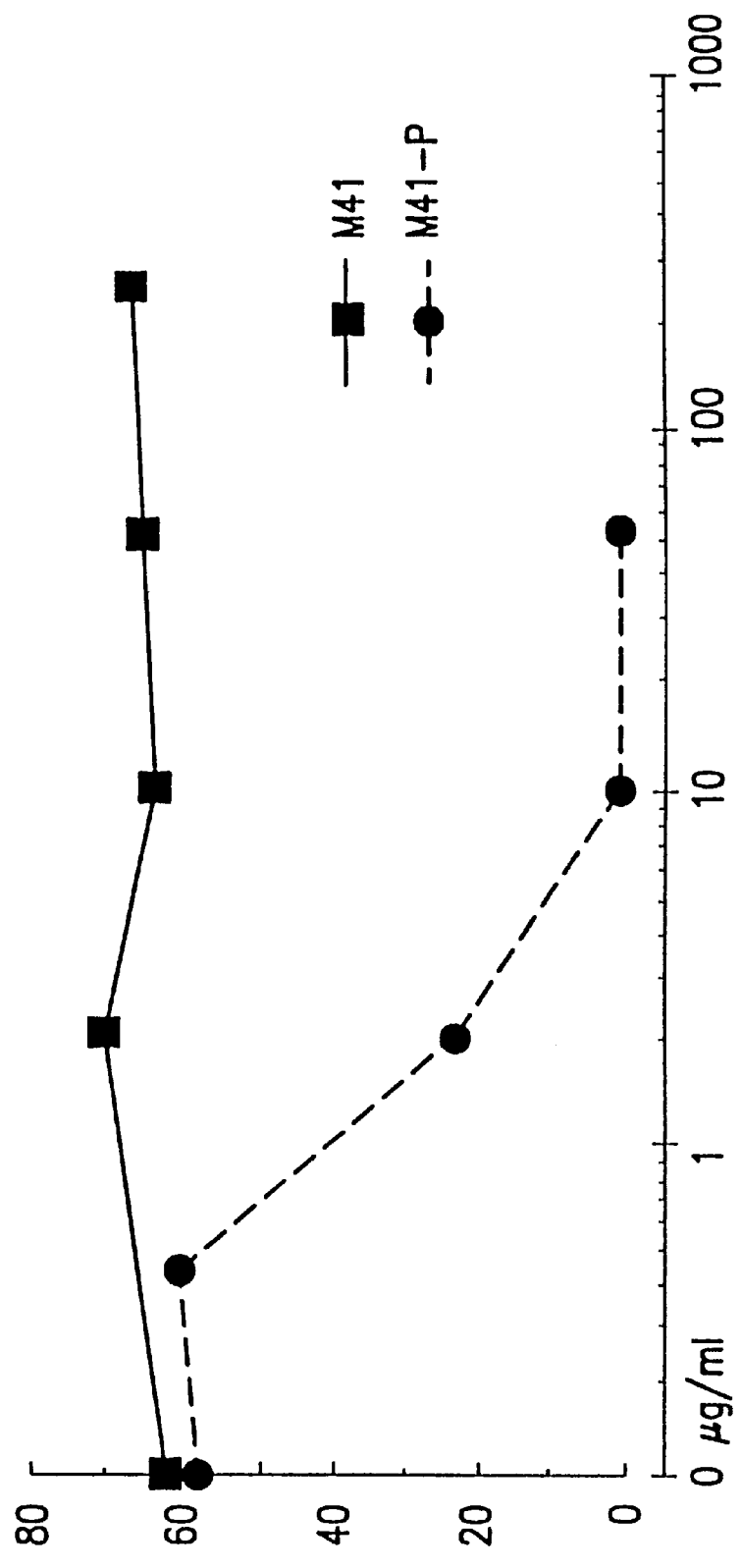

FIG. 8. A point mutation alters the conformation and anti-HIV activity of M41.

Figure 9:
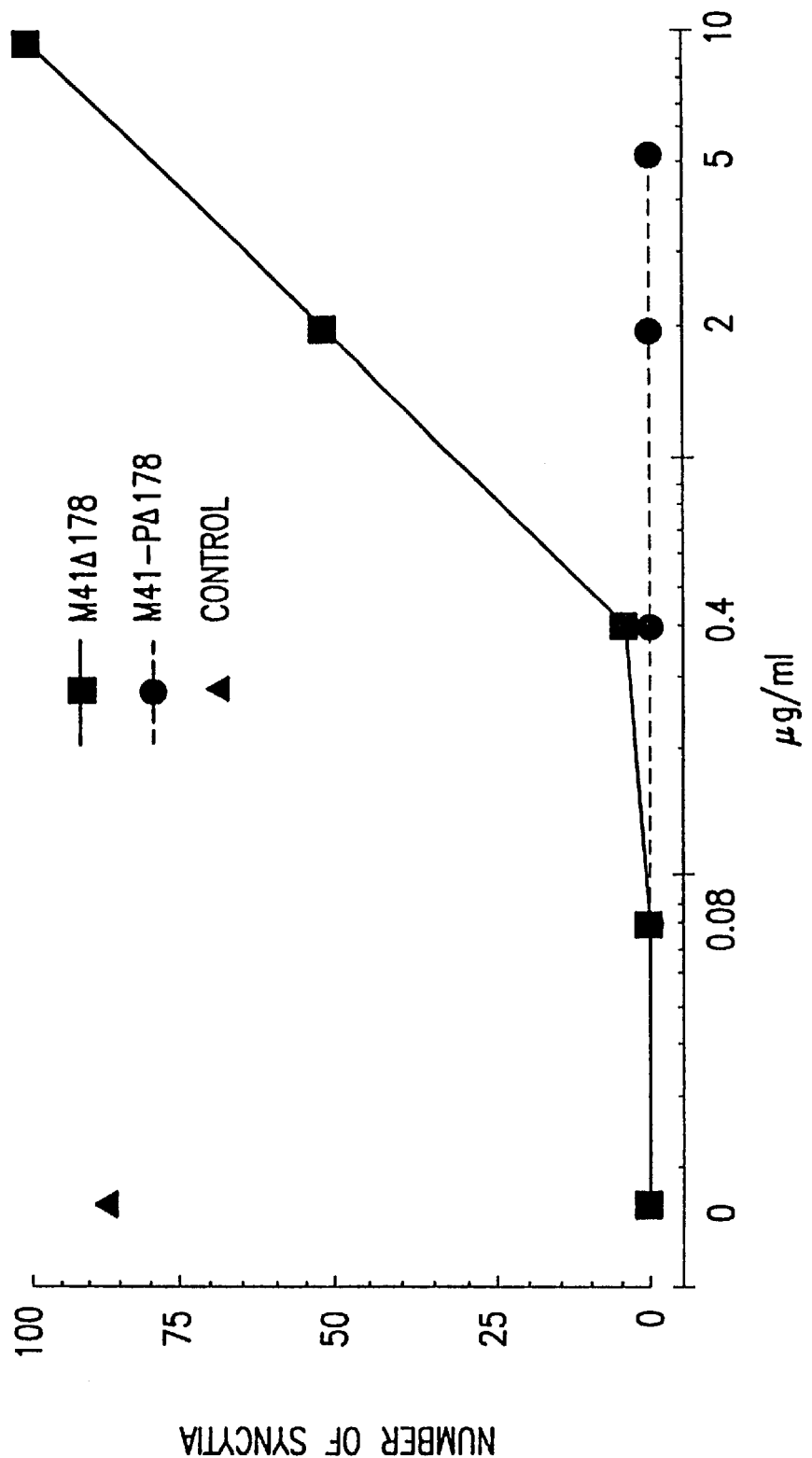

FIG. 9. Abrogation of DP178 anti-HIV activity. Cell fusion assays were carried out in the presence of 10 nM DP178 and various concentrations of M41Δ178 or M41PΔ178.

Figure 10:
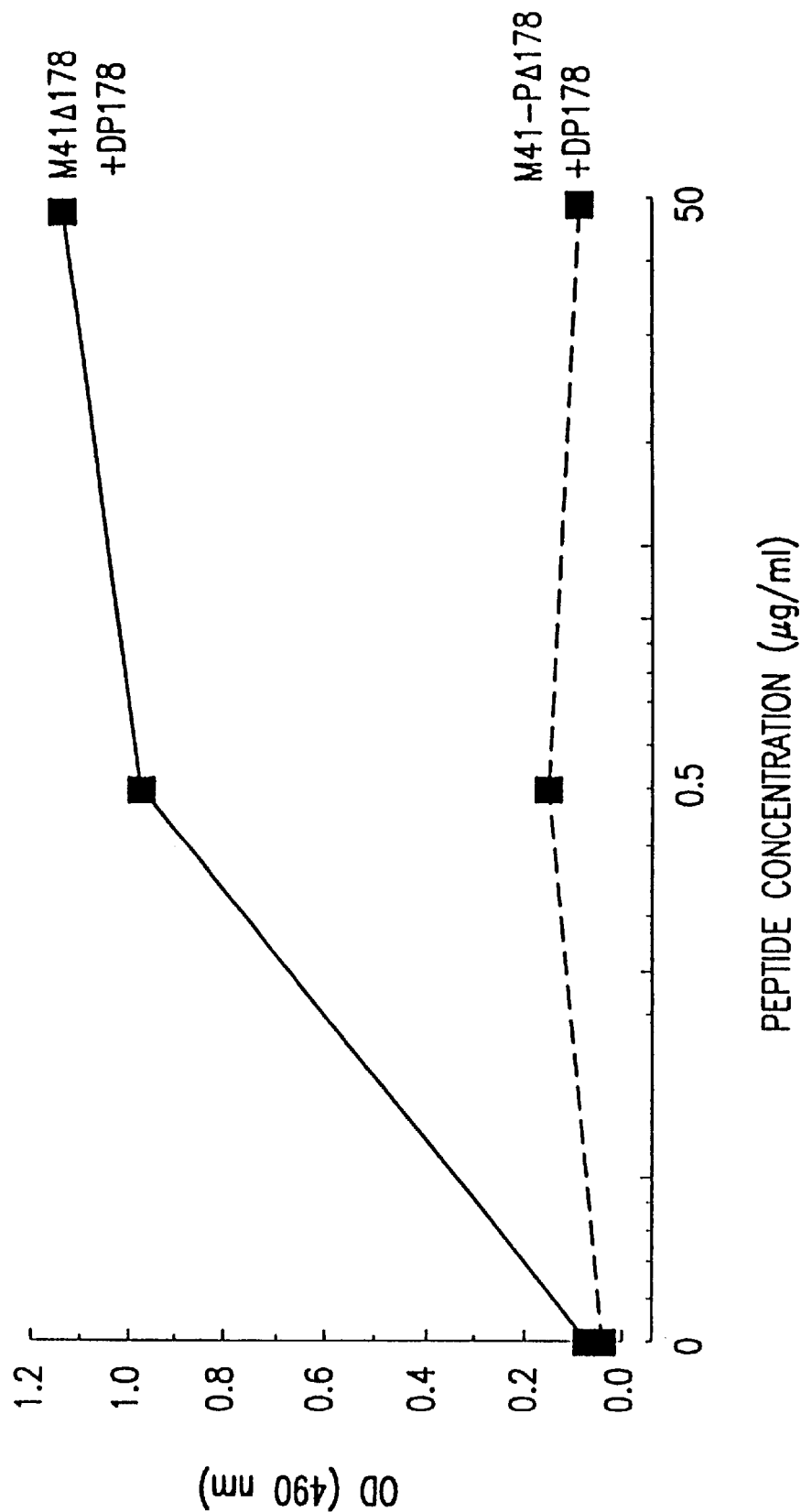

FIG. 10. Binding of DP178 to leucine zipper of gp41 analyzed by FAb-D ELISA.

Figure 11A:
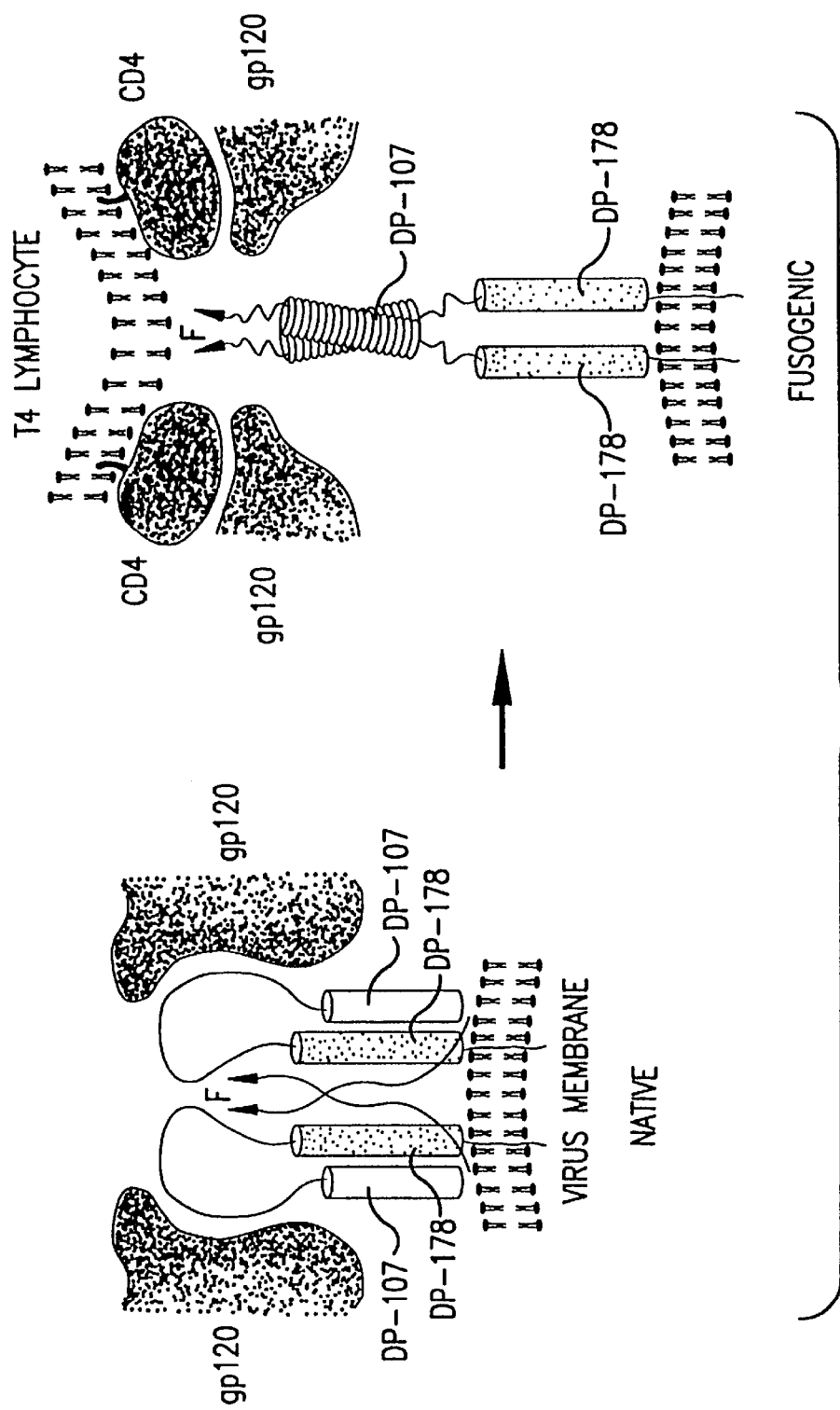
Figure 11B:
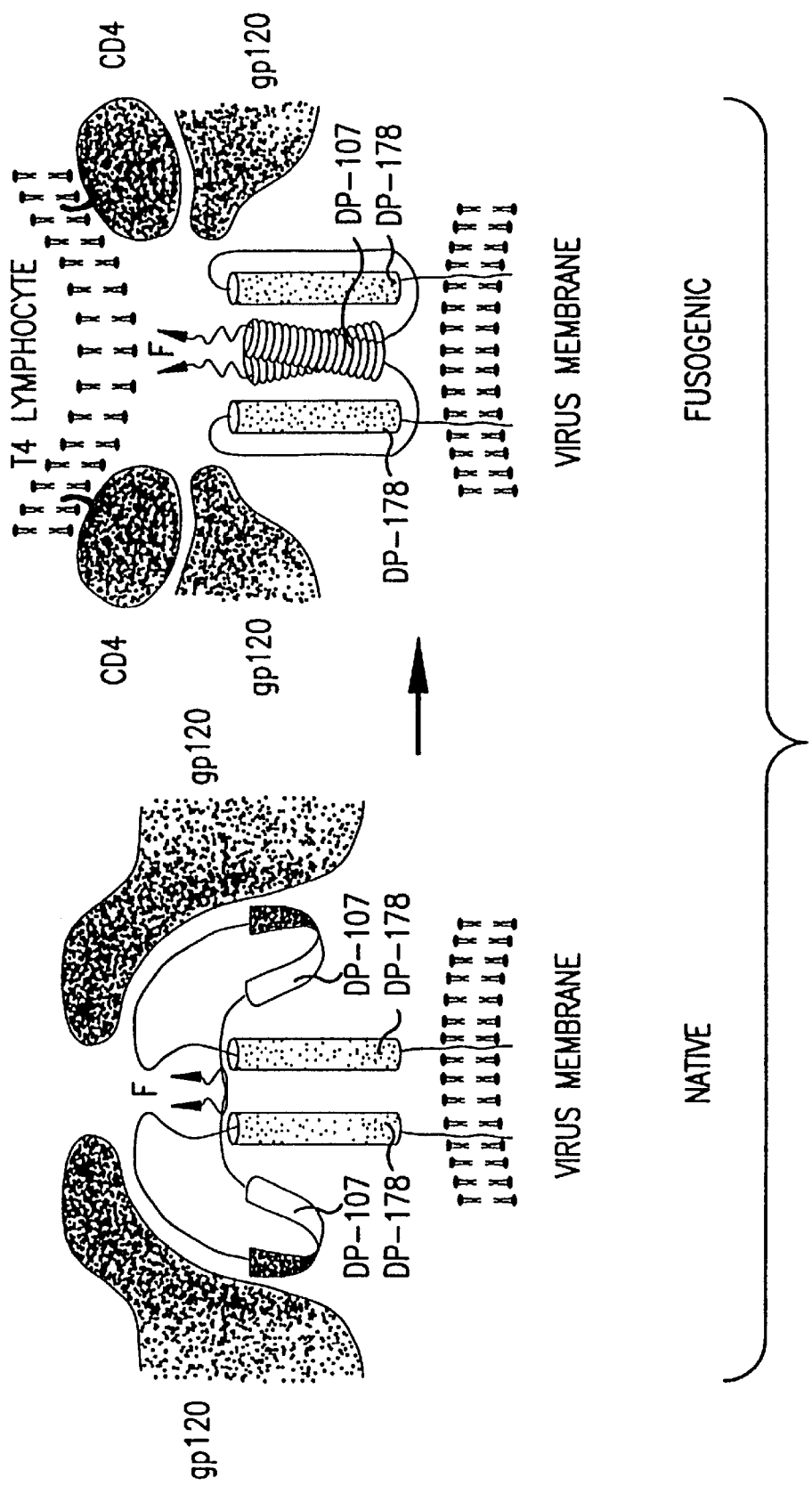

FIGS. 11A–B. Models for a structural transition in the HIV-1 TM protein. Two models are proposed which indicate a structural transition from a native oligomer to a fusogenic state following a trigger event (possibly gp120 binding to CD4). Common features of both models include (1) the native state is held together by noncovalent protein-protein interactions to form the heterodimer of gp120/41 and other interactions, principally though gp41 interactive sites, to form homo-oligomers on the virus surface of the gp120/41 complexes; (2) shielding of the hydrophobic fusogenic peptide at the N-terminus (F) in the native state; and (3) the leucine zipper domain (DP107) exists as a homo-oligomer coiled coil only in the fusogenic state. The major differences in the two models include the structural state (native or fusogenic) in which the DP107 and DP178 domains are complexed to each other. In the first model (FIG. 11A) this interaction occurs in the native state and in the second (FIG. 11B), it occurs during the fusogenic state. When triggered, the fusion complex in the model depicted in (A) is generated through formation of coiled-coil interactions in homologous DP107 domains resulting in an extended α-helix. This conformational change positions the fusion peptide for interaction with the cell membrane. In the second model (FIG. 11B), the fusogenic complex is stabilized by the association of the DP178 domain with the DP107 coiled-coil.

FIG. 12. Motif design using heptad repeat positioning of amino acids of known coiled-coils.

FIG. 13. Motif design using proposed heptad repeat positioning of amino acids of DP107 and DP178.

FIG. 14. Hybrid motif design crossing GCN4 and DP107.

FIG. 15. Hybrid motif design crossing GCN4 and DP178.

FIG. 16. Hybrid motif design 107×178×4, crossing DP107 and DP178. This motif was found to be the most consistent at identifying relevant DP107-like and DP178-like peptide regions.

FIG. 17. Hybrid motif design crossing GCN4, DP107, and DP178.

FIG. 18. Hybrid motif design ALLMOTI5 crossing GCN4, DP107, DP178, c-Fos c-Jun, c-Myc, and Flu Loop 36.

FIG. 19. PLZIP motifs designed to identify N-terminal proline-leucine zipper motifs.

FIG. 20. Search results for human respiratory syncytial virus (RSV) strain A2 fusion glycoprotein F1. Sequence search motif designations are as in FIG. 20.

Figure 21D:
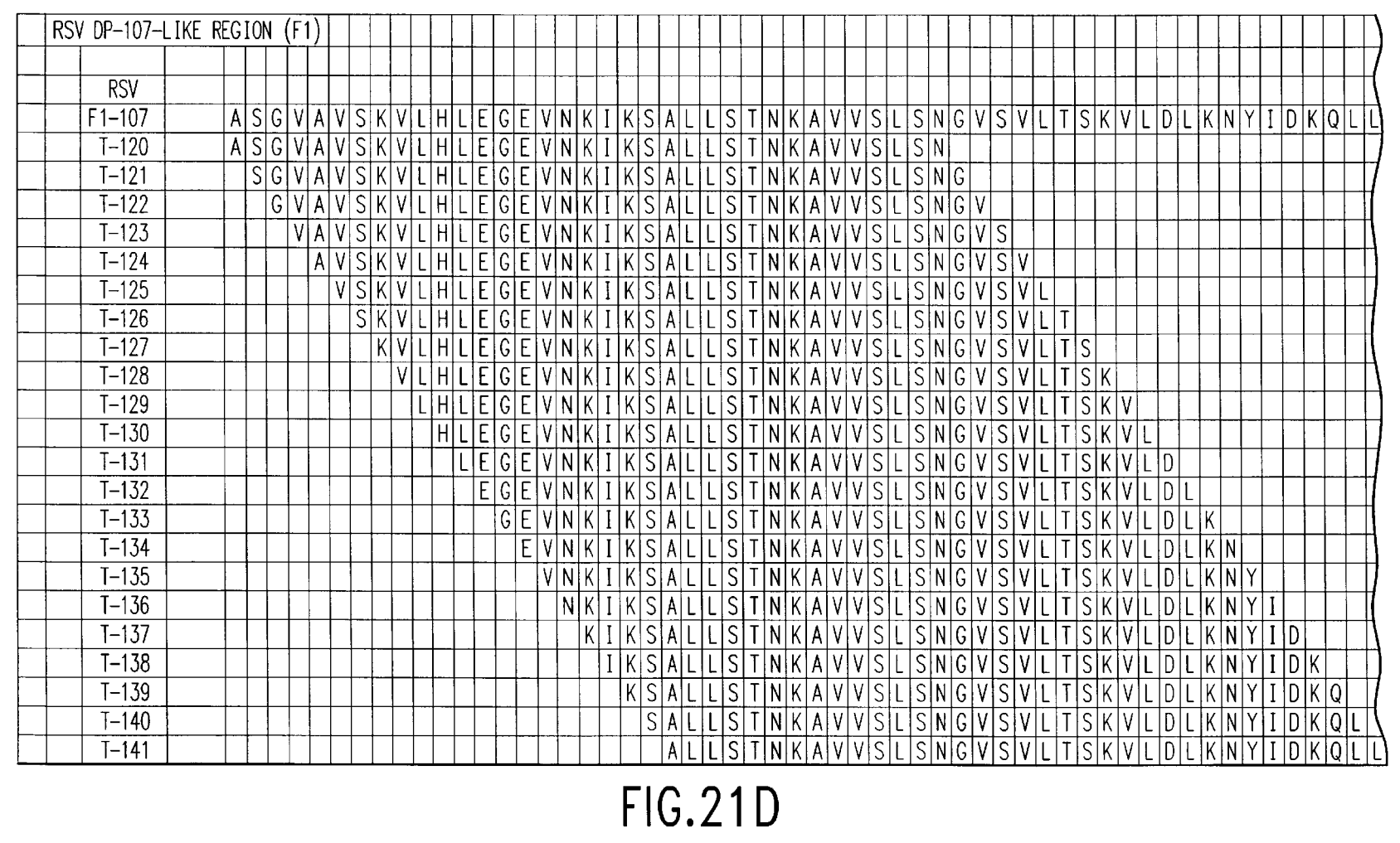

FIGS. 21A–F. Respiratory Syncytial Virus (RSV) peptide anti viral and circular dichroism data. FIGS. 21A–C: Peptides derived from the F2 DP178/DP107-like region. Antiviral and CD data. FIGS. 21D–F: Peptides derived from the F1 DP107-like region. Peptide and CD data.

Antiviral activity (AV) is represented by the following qualitative symbols:

"−", negative antiviral activity;

"+/−", antiviral activity at greater than 100 μg/ml;

"+", antiviral activity at between 50–100 μg/ml;

"++", antiviral activity at between 20–50 μg/ml;

"+++", antiviral activity at between 1–20 μg/ml;

"++++", antiviral activity at <1–20 μg/ml.

CD data, referring to the level of helicity is represented by the following qualitative symbol:

"−", no helicity;

"+", 25–50% helicity;

"++", 50–75% helicity;

"+++", 75–100% helicity.

IC$_{50}$ refers to the concentration of peptide necessary to produce only 50% of the number of syncytial relative to infected control cultures containing no peptide. IC$_{50}$ values were obtained using purified peptides only.

FIGS. 22A–C. Respiratory Syncytial Virus (RSV) DP178-like region (F1) peptide antiviral and CD data. Antiviral symbols, CD symbols, and IC$_{50}$ are as in FIGS. 21A–F. IC$_{50}$ values were obtained using purified peptides only.

FIG. 23: Cell fusion and competitive inhibition data for alanine walk experiments for the DP178-like Respiratory Syncytial Virus (RSV) peptide T112.

FIGS. 24A–B: Circular dichroism, cell fusion and competitive inhibition data for alanine walk experiments for the peptide T20, which is also known as DP178.

FIG. 25: The amino acid sequence of the full length respiratory syncytial virus fusion protein (RSV-F protein) including the $F_2$ domain (amino acid residues 1–136) and the $F_1$ domain (amino acid residues 137–574).

Figure 26:
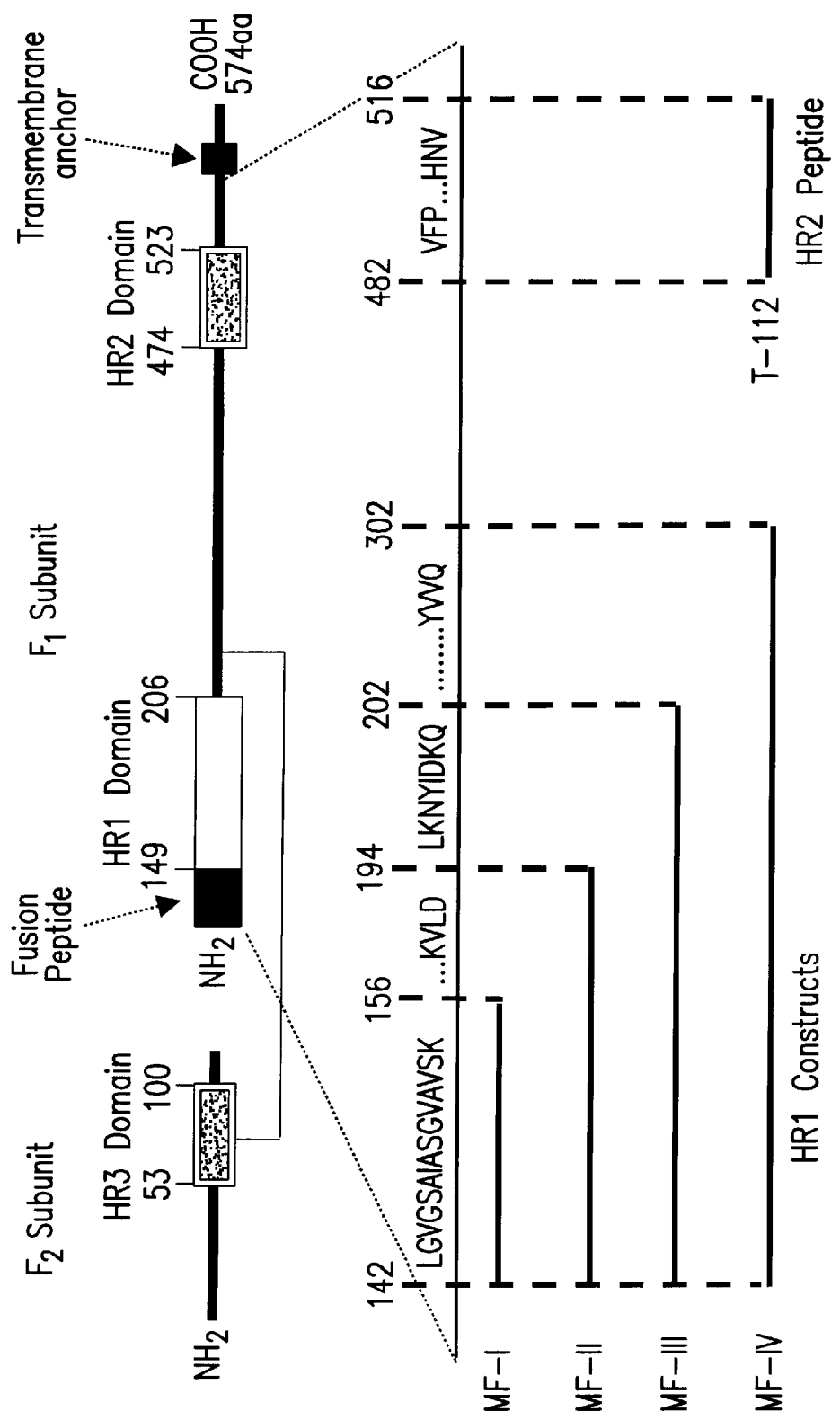

FIG. 26: A schematic illustration of the RSV-F protein $F_2$ and $F_1$ subunits illustrating the relative positions HR1 and HR2 domains; the relative positions of the sequences corresponding to the fusion proteins MF-I, MF-II, MF-III and MF-IV (HR1) and the peptide T112 (HR2) are also illustrated.

Figure 27A:
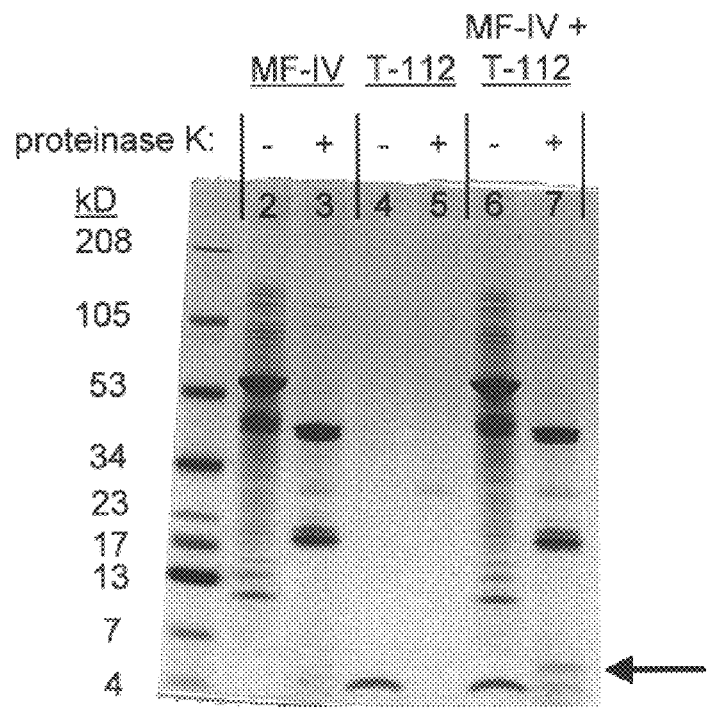
Figure 27B:
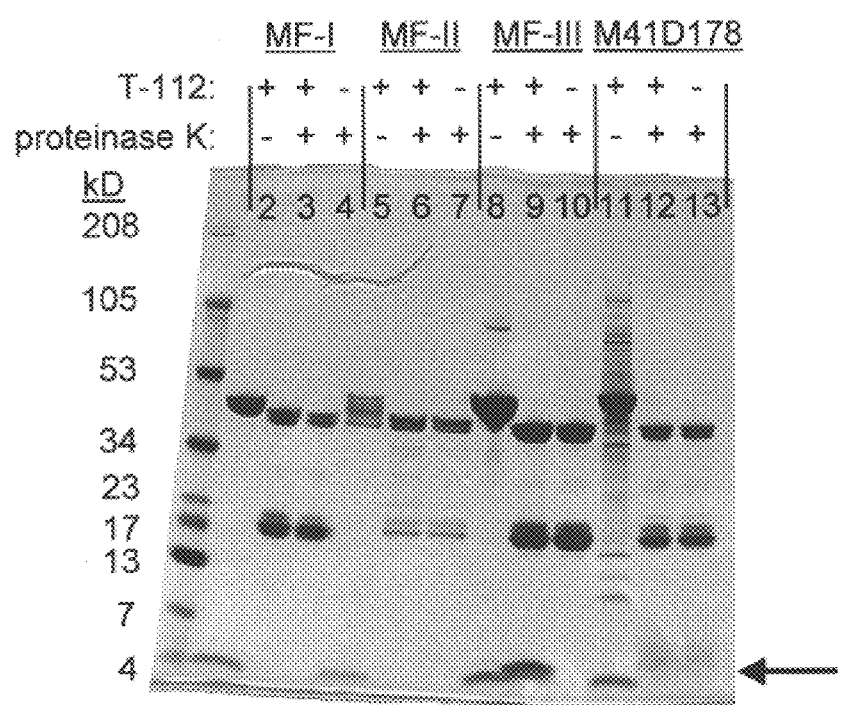

FIGS. 27A–B: SDS-PAGE results for proteinase-K treatment of the RSV-$F_1$ protein constructs; FIG. 27A: lane 1, molecular weight markers; lane 2, MF-IV; lane 3, MF-IV digested with proteinase K; lane 4, T112 alone; lane 5, T112 digested with proteinase K; lane 6, MF-IV and T112; lane 7, MF-IV and T112 digested with proteinase K; FIG. 27B: lane 1, molecular weight markers; lane 2, MF-I and T112; lane 3, MF-I and T112 treated with proteinase K; lane 4, MF-I alone treated with proteinase K; lane 5, MF-II and T112; lane 6, MF-II and T112 treated with proteinase K; lane 7, MF-II alone treated with proteinase K; lane 8 MF-III and T112; lane 9, MF-III and T112 treated with proteinase K; lane 10, MF-III alone treated with proteinase K; lanes 11–13, the HIV fusion construct M41Δ178 was run as a control; lane 11, M41Δ178 and T112; lane 12, M41Δ178 and T112 digested with proteinase K; lane 13, M41Δ178 alone digested with proteinase K.

FIG. 28: The amino acid sequence, length and $IC_{50}$ value ($\mu$g) for the RSV HR1 peptides T1536, T1590, T1585, T1582, T1581, T1583, T1772, T1584 and T1623 (SEQ ID NOS: 1543, 1549, 1548, 1545, 1544, 1546, 1551, and 1547, respectively); amino acid residues indicated in bold-faced, large-font type indicate amino acid residues at positions one and four of a heptad repeat as identified, e.g., by an ALLMOTI5 or 107×178×4 sequence search motif described in Section 5.3, below.

Figure 29A:
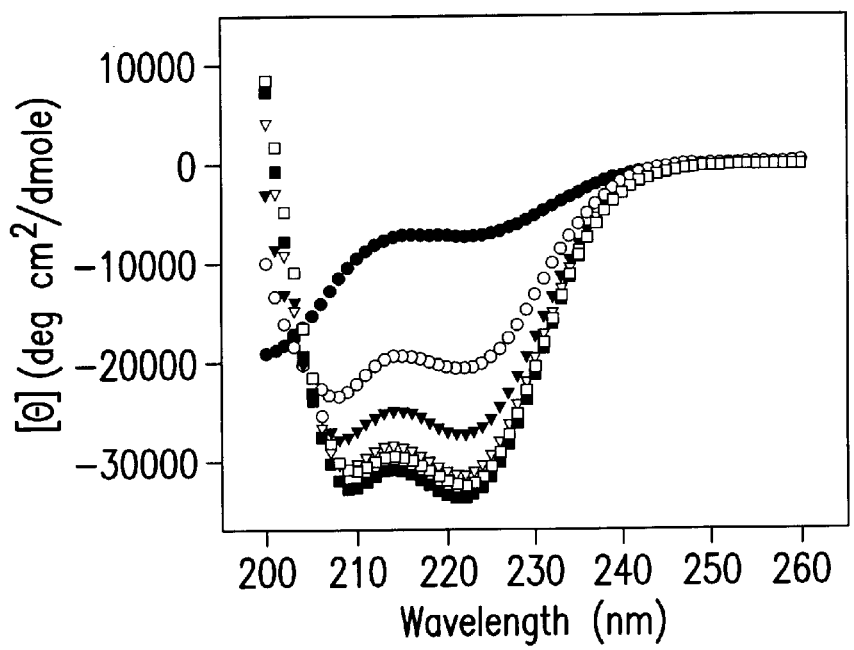
Figure 29B:
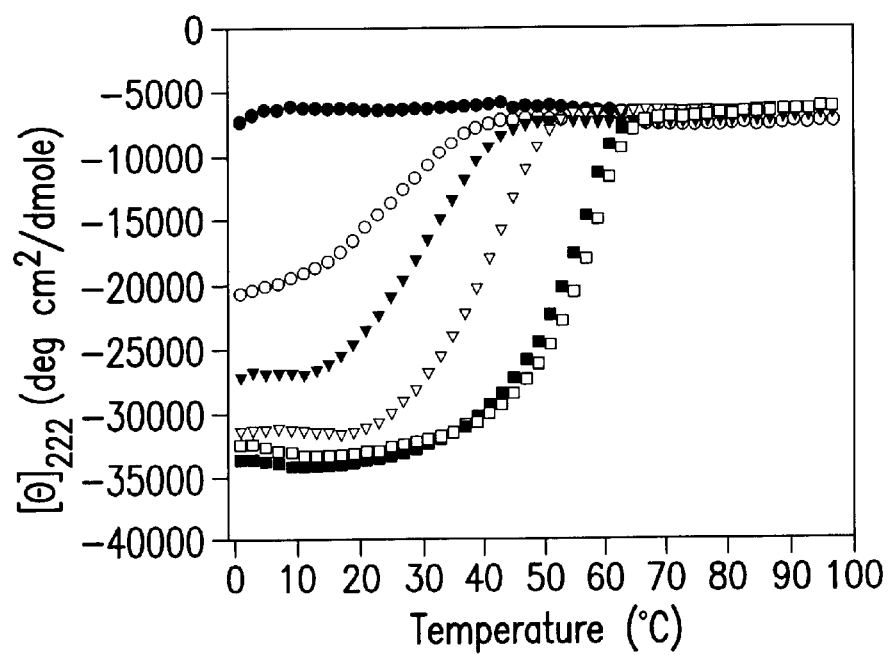

FIGS. 29A–B: Circular Dichoroism spectra (FIG. 29A) and thermal stability results (FIG. 29B) for 35 $\mu$M samples of RSV HR1 peptides is PBS at pH 7; T1590 (closed circles); T1582 (open circles); T1581 (closed triangles); T1772 (open triangles); T1584 (closed squares) and T1623 (open squares).

Figure 30:
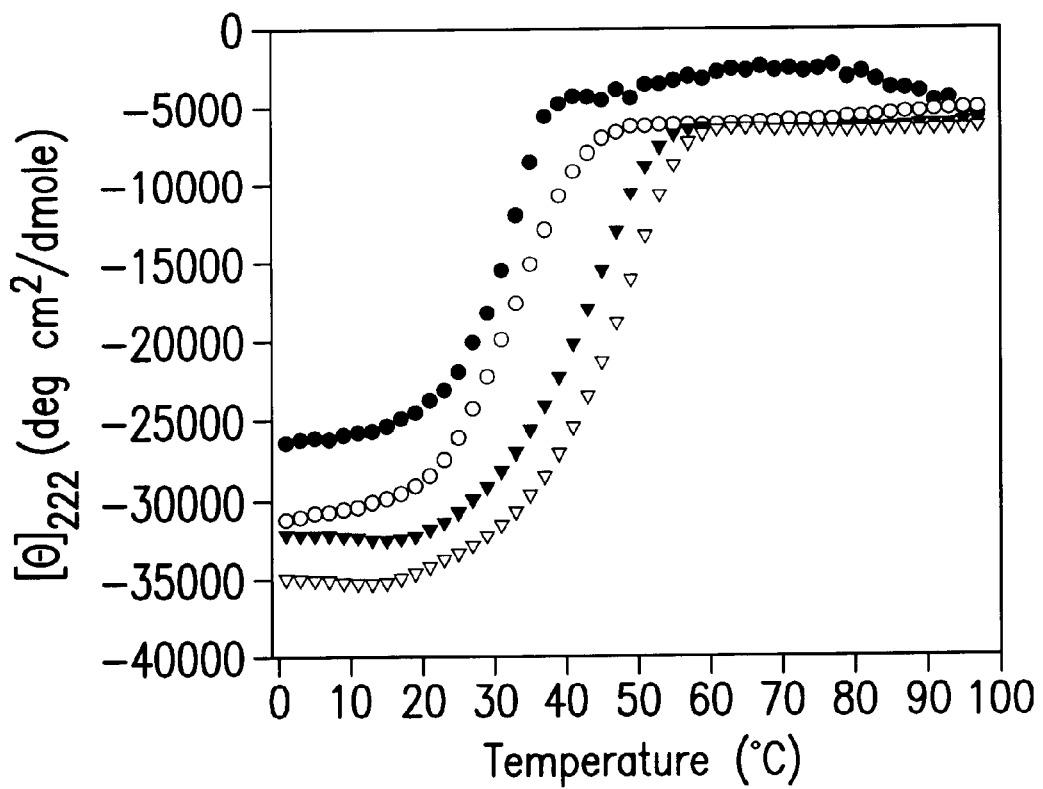

FIG. 30: A plot of the mean residue ellipticity at 222 nm as a function of temperature for increasing concentrations of the peptide T1772: 1 $\mu$M (closed circles); 10 $\mu$M (open circles); 50 $\mu$M (closed triangles); and 100 $\mu$M (open triangles).

Figure 31A:
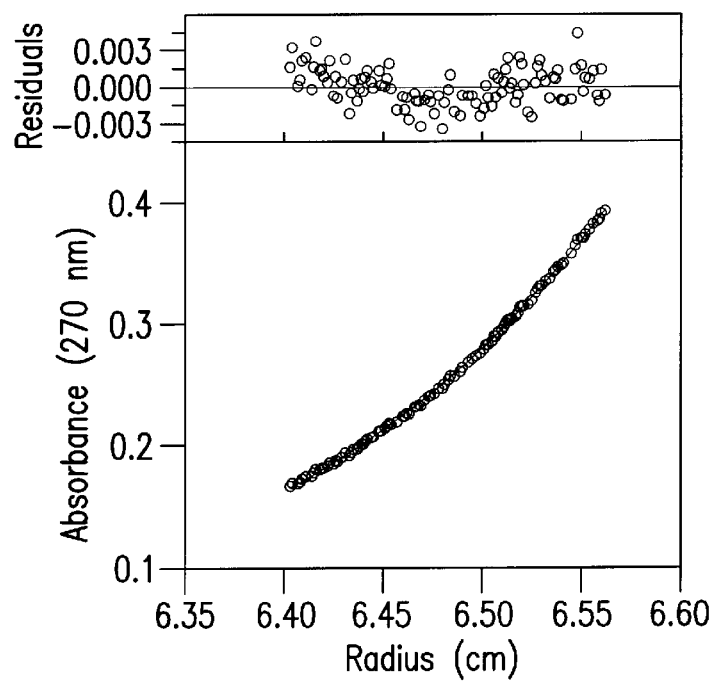
Figure 31B:
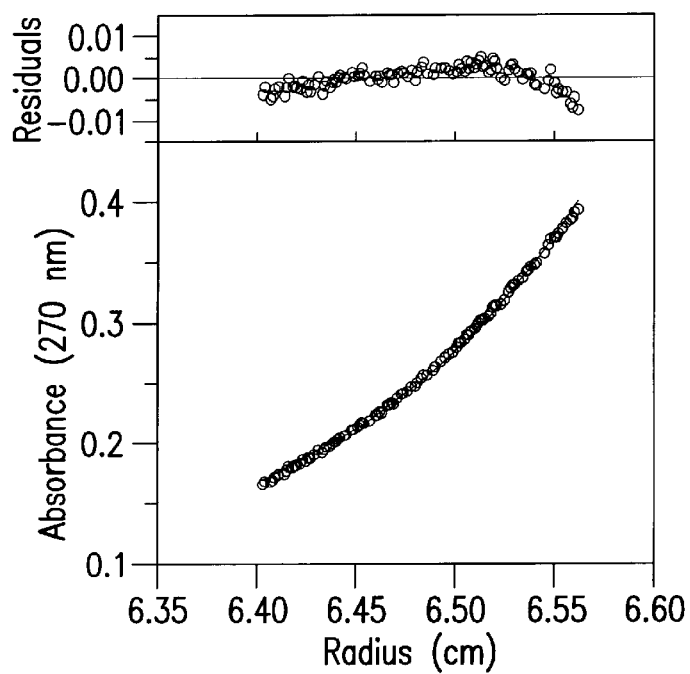
Figure 31C:
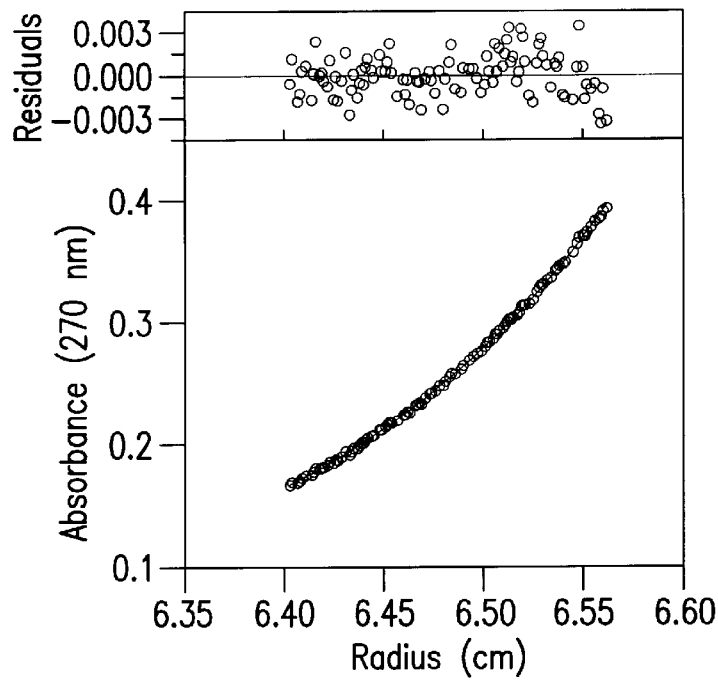
Figure 31D:
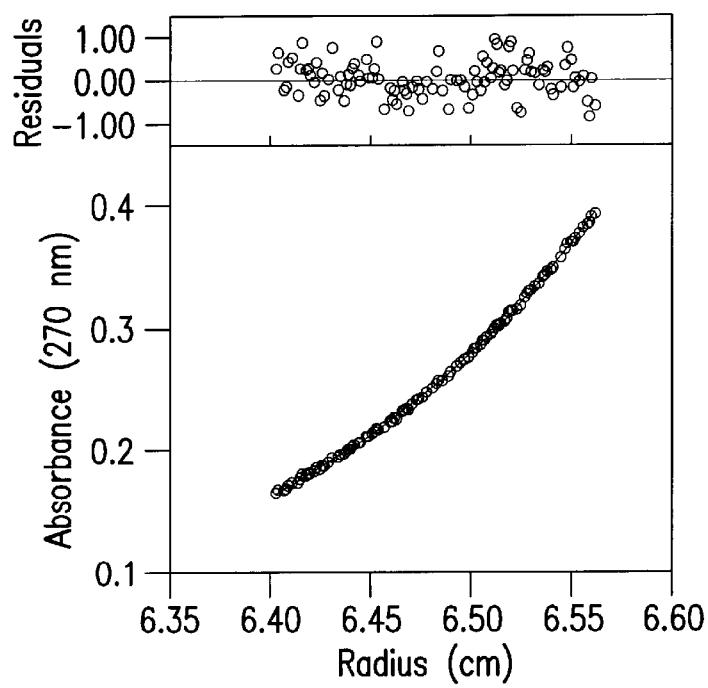

FIGS. 31A–D: Sedimentation equilibrium data (open circles) fit to representative mathematical models (superimposed solid lines) for 100 $\mu$M samples of the peptide T1772 in PBS pH 7 measured at 24,000 rpm, 4° C. Residuals are displayed above each data and calculation pair. FIG. 31A, single ideal species model fit to a single data set ($M_w$=12,925 Da; $Chi^2$=9.299×10$^{-6}$); FIG. 31B, self-association model fit to a single data set assuming a monomer/tetramer equilibrium ($K_a$=6.95×10$^{12}$ M$^{-2}$; $Chi^2$=6.766×10$^{-6}$); FIG. 31C, self-association model fit to a single data set assuming a monomer/trimer equilibrium ($K_a$=2.45×10$^9$ M$^{-2}$; $Chi^2$=2.105×10$^{-6}$); FIG. 31D, global analysis of multiple data sets using a self-association model assuming a monomer/trimer equilibrium ($K_a$=5.2×10$^8$ M$^{-2}$; Goodness of fit=0.07824; 95% confidence limit=(4.2–6.4)×10$^8$ M$^{-2}$).

Figure 32A:
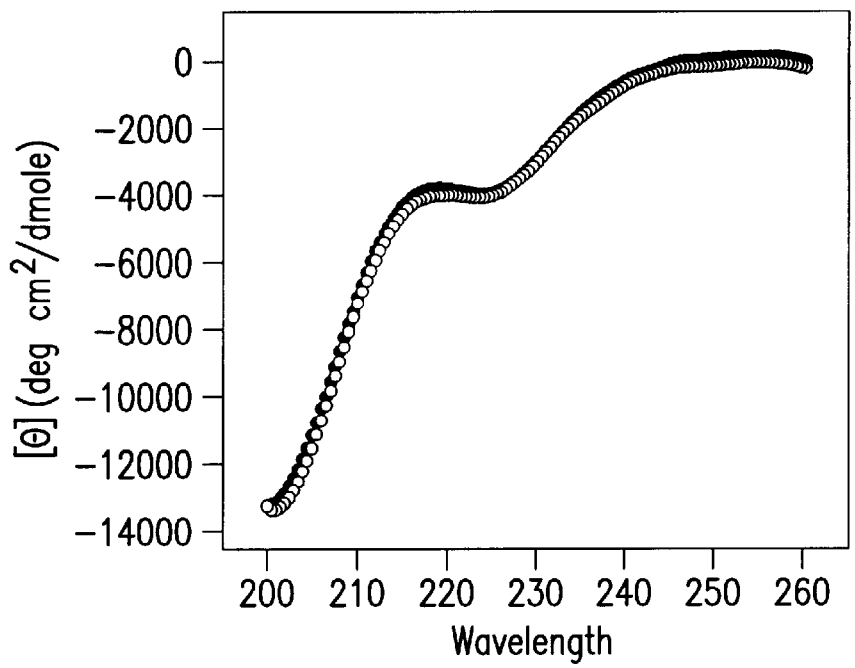
Figure 32B:
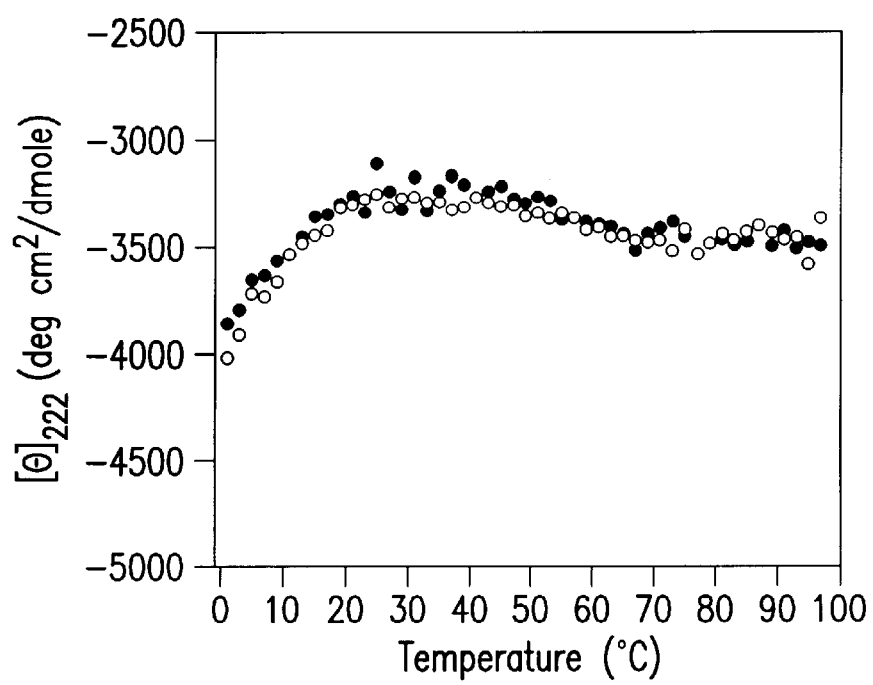

FIGS. 32A–B: Circular Dichoroism spectra (FIG. 32A) and thermal stability results (FIG. 32B) for 10 $\mu$M (closed circles) and 50 $\mu$M (opend circles) samples of the RSV HR2 peptide T112.

Figure 33A:
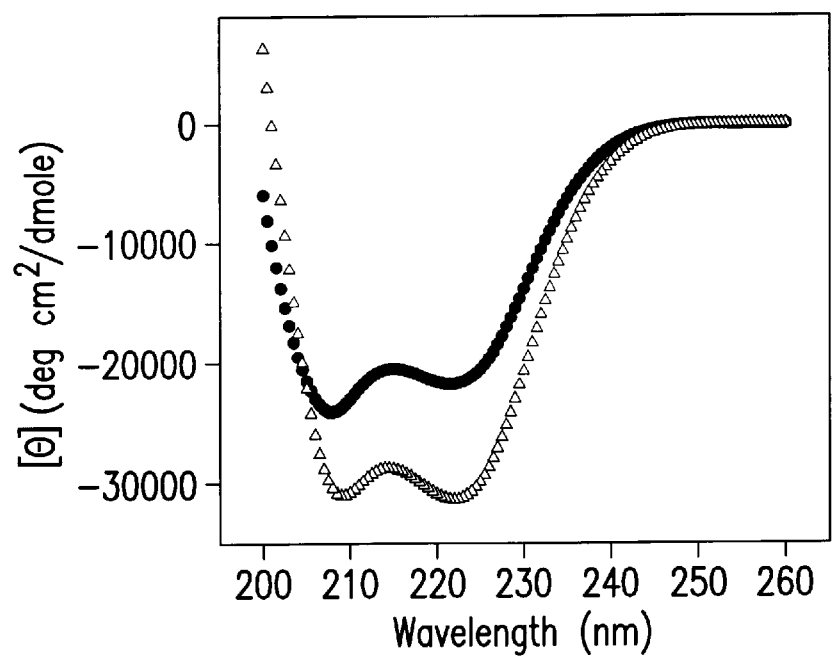
Figure 33B:
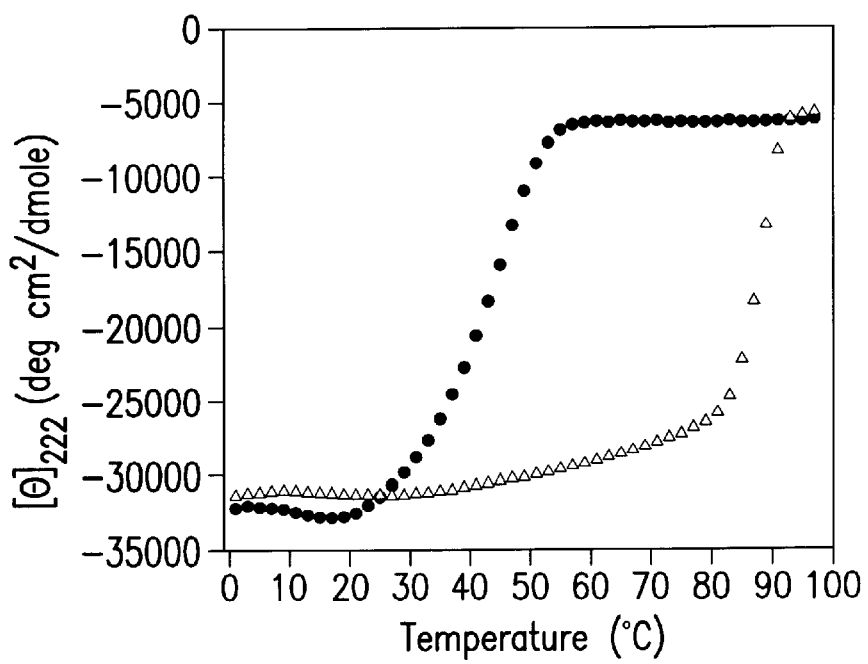

FIGS. 33A–B: Circular Dichoroism spectra (FIG. 33A) and thermal stability results (FIG. 33B) for mixtures of the RSV peptides T1172 and T112; FIG. 33A plots the experimental CD spectrum (open triangles) for a mixture of 50 $\mu$M T1772 and 50 $\mu$M T112 and a theoretical CD spectrum (closed circles) predicted from a no-interaction model for such a peptide mixture; FIG. 33B plots the mean residue ellipticity at 222 nm as a function of temperature compared for 50 $\mu$M T1772 alone (closed circles) and for a mixture of 50 $\mu$M T1772 and 50 $\mu$M T112 (open triangles).

Figure 34A:
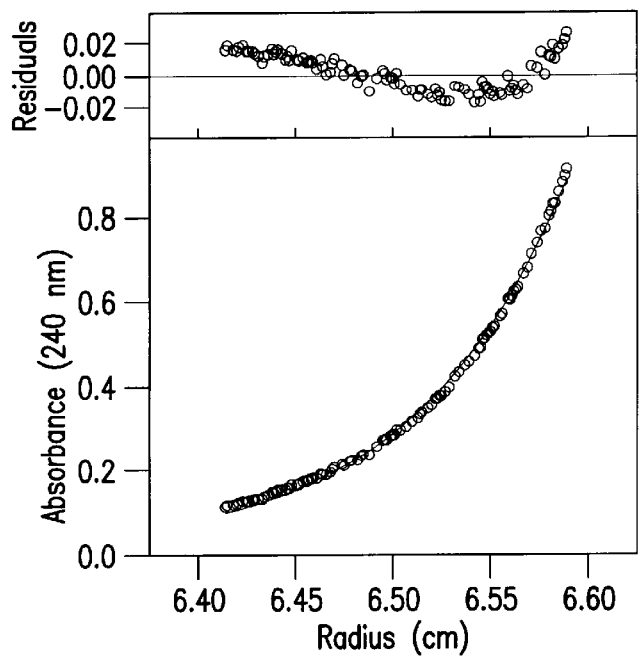
Figure 34B:
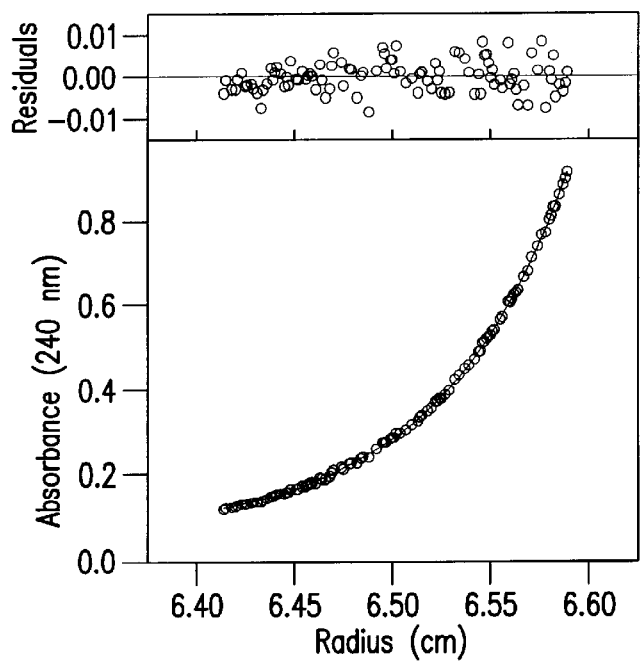
Figure 34C:
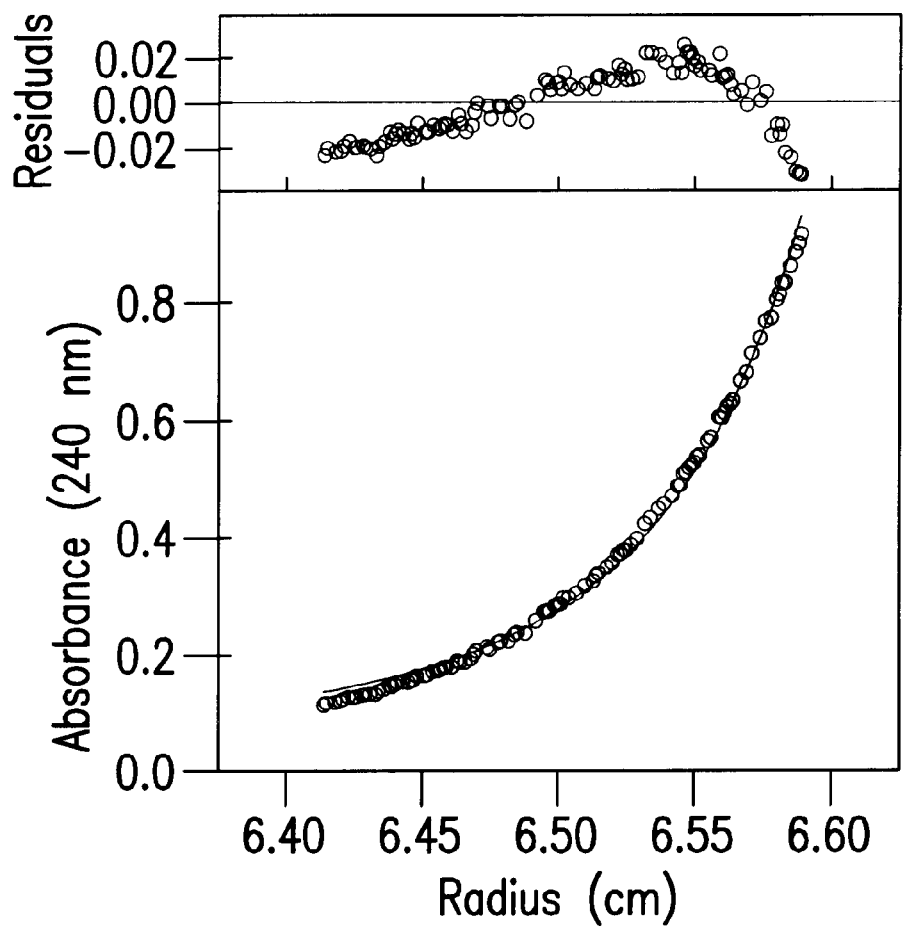

FIGS. 34A–C: Sedimentation equilibrium data (open circles) fit to representative mathematical models (superimposed solid lines) for a mixture of 50 $\mu$M T1772 and 50 $\mu$M T112 at 27,500 rpm, 4° C.; FIG. 34A, a single ideal species model fit ($M_w$=21,097 Da, $Chi^2$=1.297×10$^{-4}$); FIG. 34B, a two ideal species model fit assuming a complex of three T1772 and three T112 peptides ($Chi^2$=1.349×10$^{-5}$); FIG. 34C, two-ideal species model fit assuming a complex of four T1772 and four T112 peptides ($Chi^2$=2.230×10$^{-4}$).

5. DETAILED DESCRIPTION OF THE INVENTION

Described herein are peptides which may exhibit antifusogenic activity, antiviral capability, and/or the ability to modulate intracellular processes involving coiled-coil peptide structures. The peptides described include, first, DP178 (SEQ ID NO:1), a gp41-derived 36 amino acid peptide and fragments and analogs of DP178.

In addition, the peptides of the invention described herein include the peptide DP107 as well as peptides which are DP107 analogs. DP107 (SEQ ID NO:25) is a 38 amino acid peptide corresponding to residues 558 to 595 of the HIV-$1_{LAI}$ transmembrane (TM) gp41 protein. DP107 and DP107 analogs may exhibit antifusogenic capability, antiviral activity or an ability to modulate intracellular processes involving coiled-coil structures.

Further, peptides of the invention include DP107 and DP178 are described herein having amino acid sequences recognized by the 107×178×4, ALLMOTI5, and PLZIP search motifs. Such motifs are also discussed.

Also described here are antifusogenic, antiviral, intracellular modulatory, and diagnostic uses of the peptides of the invention. Further, procedures are described for the use of the peptides of the invention for the identification of compounds exhibiting antifusogenic, antiviral or intracellular modulatory activity.

While not limited to any theory of operation, the following model is proposed to explain the potent anti-HIV activity of DP178, based, in part, on the experiments described in the Examples, infra. In the HIV protein, gp41, DP178 corresponds to a putative α-helix region located in the C-terminal end of the gp41 ectodomain, and appears to associate with a distal site on gp41 whose interactive structure is influenced by the leucine zipper motif, a coiled-coil structure, referred to as DP107. The association of these two domains may reflect a molecular linkage or "molecular clasp" intimately involved in the fusion process. It is of interest that mutations in the C-terminal α-helix motif of gp41 (i.e., the D178 domain) tend to enhance the fusion ability of gp41, whereas mutations in the leucine zipper region (i.e., the DP107 domain) decrease or abolish the fusion ability of the viral protein. It may be that the leucine zipper motif is involved in membrane fusion while the C-terminal α-helix motif serves as a molecular safety to regulate the availability of the leucine zipper during virus-induced membrane fusion.

On the basis of the foregoing, two models are proposed of gp41-mediated membrane fusion which are schematically shown in FIGS. 11A–B. The reason for proposing two models is that the temporal nature of the interaction between the regions defined by DP107 and DP178 cannot, as yet, be pinpointed. Each model envisions two conformations for gp41—one in a "native" state as it might be found on a resting virion. The other in a "fusogenic" state to reflect conformational changes triggered following binding of gp120 to CD4 and just prior to fusion with the target cell membrane. The strong binding affinity between gp120 and CD4 may actually represent the trigger for the fusion process obviating the need for a pH change such as occurs for viruses that fuse within intracellular vesicles. The two major features of both models are: (1) the leucine zipper sequences (DP107) in each chain of oligomeric enveloped are held apart in the native state and are only allowed access to one another in the fusogenic state so as to form the extremely stable coiled-coils, and (2) association of the DP178 and DP107 sites as they exist in gp41 occur either in the native or fusogenic state. FIG. 11A depicts DP178/DP107 interaction in the native state as a molecular clasp. On the other hand, if one assumes that the most stable form of the enveloped occurs in the fusogenic state, the model in FIG. 11B can be considered.

When synthesized as peptides, both DP107 and DP178 are potent inhibitors of HIV infection and fusion, probably by virtue of their ability to form complexes with viral gp41 and interfere with its fusogenic process; e.g., during the structural transition of the viral protein from the native structure to the fusogenic state, the DP178 and DP107 peptides may gain access to their respective binding sites on the viral gp41, and exert a disruptive influence. DP107 peptides which demonstrate anti-HIV activity are described in Applicants' application Ser. No. 08/264,531, filed Jun. 23, 1994, which is incorporated by reference herein in its entirety.

As shown in the Examples, infra, a truncated recombinant gp41 protein corresponding to the ectodomain of gp41 containing both DP107 and DP178 domains (excluding the fusion peptide, transmembrane region and cytoplasmic domain of gp41) did not inhibit HIV-1 induced fusion. However, when a single mutation was introduced to disrupt the coiled-coil structure of the DP107 domain—a mutation which results in a total loss of biological activity of DP107 peptides—the inactive recombinant protein was transformed to an active inhibitor of HIV-1 induced fusion. This transformation may result from liberation of the potent DP178 domain from a molecular clasp with the leucine zipper, DP107 domain.

For clarity of discussion, the invention will be described primarily for DP178 peptide inhibitors of HIV. However, the principles may be analogously applied to other viruses, both enveloped and nonenveloped, and to other non-viral organisms.

5.1. DP178 and DP178-Like Peptides

The DP178 peptide (SEQ ID NO:15) of the invention corresponds to amino acid residues 638 to 673 of the transmembrane protein gp41 from the HIV-1$_{LAI}$ isolate, and has the 36 amino acid sequence (reading from amino to carboxy terminus):

NH$_2$-YTSLIHSLIEESQNQQEKNEQELLELDKW ASLWNWF-COOH (SEQ ID NO:15)

In addition to the full-length DP178 (SEQ ID NO:15) 36-mer, the peptides of the invention may include truncations of the DP178 (SEQ ID NO:15) peptide which exhibit antifusogenic activity, antiviral activity and/or the ability to modulate intracellular processes involving coiled-coil peptide structures. Truncations of DP178 (SEQ ID NO:15) peptides may comprise peptides of between 3 and 36 amino acid residues (i.e., peptides ranging in size from a tripeptide to a 36-mer polypeptide), as shown in Tables I and IA, below. Peptide sequences in these tables are listed from amino (left) to carboxy (right) terminus. "X" may represent an amino group (—NH$_2$) and "Z" may represent a carboxyl (—COOH) group. Alternatively, "X" may represent a hydrophobic group, including but not limited to carbobenzyl, dansyl, or T-butoxycarbonyl; an acetyl group; a 9-fluorenylmethoxy-carbonyl (FMOC) group; or a covalently attached macromolecular group, including but not limited to a lipid-fatty acid conjugate, polyethylene glycol, carbohydrate or peptide group. Further, "Z" may represent an amido group; a T-butoxycarbonyl group; or a covalently attached macromolecular group, including but not limited to a lipid-fatty acid conjugate, polyethylene glycol, carbohydrate or peptide group. A preferred "X" or "Z" macromolecular group is a peptide group.

TABLE I

DP178 (SEQ ID NO:15) CARBOXY TRUNCATIONS*

X-YTS-Z
X-YTSL-Z
X-YTSLI-Z
X-YTSLIH-Z
X-YTSLIHS-Z
X-YTSLIHSL-Z
X-YTSLIHSLI-Z
X-YTSLIHSLIE-Z
X-YTSLIHSLIEE-Z
X-YTSLIHSLIEES-Z
X-YTSLIHSLIEESQ-Z
X-YTSLIHSLIEESQN-Z
X-YTSLIHSLIEESQNQ-Z
X-YTSLIHSLIEESQNQQ-Z
X-YTSLIHSLIEESQNQQE-Z
X-YTSLIHSLIEESQNQQEK-Z
X-YTSLIHSLIEESQNQQEKN-Z
X-YTSLIHSLIEESQNQQEKNE-Z
X-YTSLIHSLIEESQNQQEKNEQ-Z
X-YTSLIHSLIEESQNQQEKNEQE-Z
X-YTSLIHSLIEESQNQQEKNEQEL-Z
X-YTSLIHSLIEESQNQQEKNEQELL-Z
X-YTSLIHSLIEESQNQQEKNEQELLE-Z
X-YTSLIHSLIEESQNQQEKNEQELLEL-Z
X-YTSLIHSLIEESQNQQEKNEQELLELD-Z
X-YTSLIHSLIEESQNQQEKNEQELLELDK-Z
X-YTSLIHSLIEESQNQQEKNEQELLELDKW-Z
X-YTSLIHSLIEESQNQQEKNEQELLELDKWA-Z
X-YTSLIHSLIEESQNQQEKNEQELLELDKWAS-Z
X-YTSLIHSLIEESQNQQEKNEQELLELDKWASL-Z
X-YTSLIHSLIEESQNQQEKNEQELLELDKWASLW-Z
X-YTSLIHSLIEESQNQQEKNEQELLELDKWASLWN-Z
X-YTSLIHSLIEESQNQQEKNEQELLELDKWASLWNW-Z
X-YTSLIHSLIEESQNQQEKNEQELLELDKWASLWNWF-Z
(SEQ ID NOS:1622–1654 and 15, respectively)

(*The one-letter amino acid code is used)

TABLE IA

DP178 (SEQ ID NO:15) AMINO TRUNCATIONS*

X-NWF-Z
X-WNWF-Z
X-LWNWF-Z
X-SLWNWF-Z
X-ASLWNWF-Z
X-WASLWNWF-Z
X-KWASLWNWF-Z

TABLE IA-continued

DP178 (SEQ ID NO:15) AMINO TRUNCATIONS*

X-DKWASLWNWF-Z
X-LDKWASLWNWF-Z
X-ELDKWASLWNWF-Z
X-LELDKWASLWNWF-Z
X-LLELDKWASLWNWF-Z
X-ELLELDKWASLWNWF-Z
X-QELLELDKWASLWNWF-Z
X-EQELLELDKWASLWNWF-Z
X-NEQELLELDKWASLWNWF-Z
X-KNEQELLELDKWASLWNWF-Z
X-EKNEQELLELDKWASLWNWF-Z
X-QEKNEQELLELDKWASLWNWF-Z
X-QQEKNEQELLELDKWASLWNWF-Z
X-NQQEKNEQELLELDKWASLWNWF-Z
X-QNQQEKNEQELLELDKWASLWNWF-Z
X-SQNQQEKNEQELLELDKWASLWNWF-Z
X-ESQNQQEKNEQELLELDKWASLWNWF-Z
X-EESQNQQEKNEQELLELDKWASLWNWF-Z
X-IEESQNQQEKNEQELLELDKWASLWNWF-Z
X-LIEESQNQQEKNEQELLELDKWASLWNWF-Z
X-SLIEESQNQQEKNEQELLELDKWASLWNWF-Z
X-HSLIEESQNQQEKNEQELLELDKWASLWNWF-Z
X-IHSLIEESQNQQEKNEQELLELDKWASLWNWF-Z
X-LIHSLIEESQNQQEKNEQELLELDKWASLWNWF-Z
X-SLIHSLIEESQNQQEKNEQELLELDKWASLWNWF-Z
X-TSLIHSLIEESQNQQEKNEQELLELDKWASLWNWF-Z
X-YTSLIHSLIEESQNQQEKNEQELLELDKWASLWNWF-Z
(SEQ ID NOS:1655–1687 and 15, respectively)

(*The one-letter amino acid code is used.)

The peptides of the invention also include DP178-like peptides. The term "DP178-like", as used herein, refers, first, to DP178 and DP178 truncations which contain one or more amino acid substitutions, insertions and/or deletions. Second, "DP178-like" also refers to peptide sequences corresponding to amino acid sequences found in HR2 and HR2-like domains of other proteins. In a particularly preferred embodiment, the DP178-like peptides of the invention are peptides whose amino acid sequences correspond to sequences found in HR2 or HR2-like domains of other fusion proteins, particularly other viral fusion proteins. For example, and not by way of limitation, the Examples presented, below, in Sections 10–13 describe the identification of an HR2 domain in the respiratory syncytial virus $F_1$-fusion protein (RSV $F_1$-protein) as well as DP178-like peptides from this HR2 domain. Such DP178-like peptides are therefore intended to be within the scope of the present invention. The "DP-178-like" peptides of the invention also include peptide sequences identified or recognized by the ALLMOTI5, 107×178×4 and PLZIP search motifs described herein, having structural and/or amino acid motif similarity to DP178. The DP178-like peptides of the invention may exhibit antifusogenic or antiviral activity, or may exhibit the ability to modulate intracellular processes involving coiled-coil peptides. Further, such DP178-like peptides may possess additional advantageous features, such as, for example, increased bioavailability, and/or stability, or reduced host immune recognition.

HIV-1 and HIV-2 enveloped proteins are structurally distinct, but there exists a striking amino acid conservation within the DP178-corresponding regions of HIV-1 and HIV-2. The amino acid conservation is of a periodic nature, suggesting some conservation of structure and/or function. Therefore, one possible class of amino acid substitutions would include those amino acid changes which are predicted to stabilize the structure of the DP178 peptides of the invention. Utilizing the DP178 and DP178 analog sequences described herein, the skilled artisan can readily compile DP178 consensus sequences and ascertain from these, conserved amino acid residues which would represent preferred amino acid substitutions.

The amino acid substitutions may be of a conserved or non-conserved nature. Conserved amino acid substitutions consist of replacing one or more amino acids of the DP178 (SEQ ID NO:15) peptide sequence with amino acids of similar charge, size, and/or hydrophobicity characteristics, such as, for example, a glutamic acid (E) to aspartic acid (D) amino acid substitution. Non-conserved substitutions consist of replacing one or more amino acids of the DP178 (SEQ ID NO:15) peptide sequence with amino acids possessing dissimilar charge, size, and/or hydrophobicity characteristics, such as, for example, a glutamic acid (E) to valine (V) substitution.

Amino acid insertions may consist of single amino acid residues or stretches of residues. The insertions may be made at the carboxy or amino terminal end of the DP178 or DP178 truncated peptides, as well as at a position internal to the peptide. Such insertions will generally range from 2 to 15 amino acids in length. It is contemplated that insertions made at either the carboxy or amino terminus of the peptide of interest may be of a broader size range, with about 2 to about 50 amino acids being preferred. One or more such insertions may be introduced into DP178 (SEQ.ID NO:15) or DP178 truncations, as long as such insertions result in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures.

Preferred amino or carboxy terminal insertions are peptides ranging from about 2 to about 50 amino acid residues in length, corresponding to gp41 protein regions either amino to or carboxy to the actual DP178 gp41 amino acid sequence, respectively. Thus, a preferred amino terminal or carboxy terminal amino acid insertion would contain gp41 amino acid sequences found immediately amino to or carboxy to the DP178 region of the gp41 protein.

Deletions of DP178 (SEQ ID NO:15) or DP178 truncations are also within the scope of the invention. Such deletions consist of the removal of one or more amino acids from the DP178 or DP178-like peptide sequence, with the lower limit length of the resulting peptide sequence being 4 to 6 amino acids. Such deletions may involve a single contiguous or greater than one discrete portion of the peptide sequences. One or more such deletions may be introduced into DP178 (SEQ.ID NO:15) or DP178 truncations, as long as such deletions result in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures. DP178 analogs are further described, below, in Section 5.3.

5.2. DP107 and DP107-Like Peptides

Further, the peptides of the invention include peptides having amino acid sequences corresponding to DP107 analogs. DP107 is a 38 amino acid peptide which exhibits potent antiviral activity, and corresponds to residues 558 to 595 of HIV-1$_{LAI}$ transmembrane (TM) gp41 protein, as shown here:

NH$_2$-NNLLRAIEAQQHLLQLTVWGIKQLQARIL
  AVERYLKDQ-COOH (SEQ ID NO:16)

In addition to the full-length DP107 (SEQ ID NO:16) 38-mer, the peptides of the invention may include truncations of the DP107 (SEQ ID NO:16) peptide which exhibit antifusogenic activity, antiviral activity and/or the ability to modulate intracellular processes involving coiled-coil peptide structures. Truncations of DP107 (SEQ ID NO:16) peptides may comprise peptides of between 3 and 38 amino acid residues (i.e., peptides ranging in size from a tripeptide to a 38-mer polypeptide), as shown in Tables II and IIA, below. Peptide sequences in these tables are listed from amino (left) to carboxy (right) terminus. "X" may represent an amino group (—NH$_2$) and "Z" may represent a carboxyl (—COOH) group. Alternatively, "X" may represent a hydrophobic group, including but not limited to carbobenzyl, dansyl, or T-butoxycarbonyl; an acetyl group; a 9-fluorenylmethoxy-carbonyl (FMOC) group; or a covalently attached macromolecular group, including but not limited to a lipid-fatty acid conjugate, polyethylene glycol, carbohydrate or peptide group. Further, "Z" may represent an amido group; a T-butoxycarbonyl group; or a covalently attached macromolecular group, including but not limited to a lipid-fatty acid conjugate, polyethylene glycol, carbohydrate or peptide group. A preferred "X" or "Z" macromolecular group is a peptide group.

TABLE II

DP107 (SEQ ID NO:16) CARBOXY TRUNCATIONS

X-NNL-Z
X-NNLL-Z
X-NNLLR-Z
X-NNLLRA-Z
X-NNLLRAI-Z
X-NNLLRAIE-Z
X-NNLLRAIEA-Z
X-NNLLRAIEAQ-Z
X-NNLLRAIEAQQ-Z
X-NNLLRAIEAQQH-Z
X-NNLLRAIEAQQHL-Z
X-NNLLRAIEAQQHLL-Z
X-NNLLRAIEAQQHLLQ-Z
X-NNLLRAIEAQQHLLQL-Z
X-NNLLRAIEAQQHLLQLT-Z
X-NNLLRAIEAQQHLLQLTV-Z
X-NNLLRAIEAQQHLLQLTVW-Z
X-NNLLRAIEAQQHLLQLTVWG-Z
X-NNLLRAIEAQQHLLQLTVWGI-Z
X-NNLLRAIEAQQHLLQLTVWGIK-Z
X-NNLLRAIEAQQHLLQLTVWGIKQ-Z
X-NNLLRAIEAQQHLLQLTVWGIKQL-Z
X-NNLLRAIEAQQHLLQLTVWGIKQLQ-Z
X-NNLLRAIEAQQHLLQLTVWGIKQLQA-Z
X-NNLLRAIEAQQHLLQLTVWGIKQLQAR-Z
X-NNLLRAIEAQQHLLQLTVWGIKQLQARI-Z
X-NNLLRAIEAQQHLLQLTVWGIKQLQARIL-Z
X-NNLLRAIEAQQHLLQLTVWGIKQLQARILA-Z
X-NNLLRAIEAQQHLLQLTVWGIKQLQARILAV-Z
X-NNLLRAIEAQQHLLQLTVWGIKQLQARILAVE-Z
X-NNLLRAIEAQQHLLQLTVWGIKQLQARILAVER-Z
X-NNLLRAIEAQQHLLQLTVWGIKQLQARILAVERY-Z
X-NNLLRAIEAQQHLLQLTVWGIKQLQARILAVERYL-Z
X-NNLLRAIEAQQHLLQLTVWGIKQLQARILAVERYLK-Z
X-NNLLRAIEAQQHLLQLTVWGIKQLQARILAVERYLKD-Z
X-NNLLRAIEAQQHLLQLTVWGIKQLQARILAVERYLKDQ-Z
(SEQ ID NOS:1688–1722 and 16, respectively)

(*The one-letter amino acid code is used.)

TABLE IIA

DP178 (SEQ ID NO:16) AMINO TRUNCATIONS*

X-KDQ-Z
X-LKDQ-Z
X-YLKDQ-Z
X-RYLKDQ-Z

TABLE IIA-continued

DP178 (SEQ ID NO:16) AMINO TRUNCATIONS*

X-ERYLKDQ-Z
X-VERYLKDQ-Z
X-AVERYLKDQ-Z
X-LAVERYLKDQ-Z
X-ILAVERYLKDQ-Z
X-RILAVERYLKDQ-Z
X-ARILAVERYLKDQ-Z
X-QARILAVERYLKDQ-Z
X-LQARILAVERYLKDQ-Z
X-QLQARILAVERYLKDQ-Z
X-KQLQARILAVERYLKDQ-Z
X-IKQLQARILAVERYLKDQ-Z
X-GIKQLQARILAVERYLKDQ-Z
X-WGIKQLQARILAVERYLKDQ-Z
X-VWGIKQLQARILAVERYLKDQ-Z
X-TVWGIKQLQARILAVERYLKDQ-Z
X-LTVWGIKQLQARILAVERYLKDQ-Z
X-QLTVWGIKQLQARILAVERYLKDQ-Z
X-LQLTVWGIKQLQARILAVERYLKDQ-Z
X-LLQLTVWGIKQLQARILAVERYLKDQ-Z
X-HLLQLTVWGIKQLQARILAVERYLKDQ-Z
X-QHLLQLTVWGIKQLQARILAVERYLKDQ-Z
X-QQHLLQLTVWGIKQLQARILAVERYLKDQ-Z
X-AQQHLLQLTVWGIKQLQARILAVERYLKDQ-Z
X-EAQQHLLQLTVWGIKQLQARILAVERYLKDQ-Z
X-IEAQQHLLQLTVWGIKQLQARILAVERYLKDQ-Z
X-AIEAQQHLLQLTVWGIKQLQARILAVERYLKDQ-Z
X-RAIEAQQHLLQLTVWGIKQLQARILAVERYLKDQ-Z
X-LRAIEAQQHLLQLTVWGIKQLQARILAVERYLKDQ-Z
X-LLRAIEAQQHLLQLTVWGIKQLQARILAVERYLKDQ-Z
X-NLLRAIEAQQHLLQLTVWGIKQLQARILAVERYLKDQ-Z
X-NNLLRAIEAQQHLLQLTVWGIKQLQARILAVERYLKDQ-Z
(SEQ ID NOS:1723–1757 and 16, respectively)

(*The one-letter amino acid code is used)

The peptides of the invention also include DP107-like peptides. The term "DP107-like", as used herein, refers, first, to DP107 and DP107 truncations which contain one or more amino acid substitutions, insertions and/or deletions. Second, "DP107-like" also refers to peptide sequences corresponding to amino acid sequences found in HR1 and HR1-like domains of other proteins. In a particularly preferred embodiment, the DP107-like peptides of the invention are peptides whose amino acid sequences correspond to sequences found in HR1 or HR1-like domains of other fusion proteins, particularly other viral fusion proteins. For example, and not by way of limitation, the Examples presented, below, in Sections 10–13 describe the identification of an HR1 domain in the respiratory syncytial virus F$_1$-fusion protein (RSV F$_1$-protein) as well as DP107-like peptides from this HR2 domain. Such DP107-like peptides are therefore intended to be within the scope of the present invention. The "DP-107-like" peptides of the invention also include peptide sequences identified or recognized by the ALLMOTI5, 107×178×4 and PLZIP search motifs described herein, having structural and/or amino acid motif similarity to DP107. The DP107-like peptides of the invention may exhibit antifusogenic or antiviral activity, or may exhibit the ability to modulate intracellular processes involving coiled-coil peptides. Further, such DP107-like peptides may possess additional advantageous features, such as, for example, increased bioavailability, and/or stability, or reduced host immune recognition.

HIV-1 and HIV-2 enveloped proteins are structurally distinct, but there exists a striking amino acid conservation within the DP107-corresponding regions of HIV-1 and HIV-2. The amino acid conservation is of a periodic nature, suggesting some conservation of structure and/or function. Therefore, one possible class of amino acid substitutions would include those amino acid changes which are predicted to stabilize the structure of the DP107 peptides of the invention. Utilizing the DP107 and DP107 analog sequences described herein, the skilled artisan can readily compile DP107 consensus sequences and ascertain from these, conserved amino acid residues which would represent preferred amino acid substitutions.

The amino acid substitutions may be of a conserved or non-conserved nature. Conserved amino acid substitutions consist of replacing one or more amino acids of the DP107 (SEQ ID NO:16) peptide sequence with amino acids of similar charge, size, and/or hydrophobicity characteristics, such as, for example, a glutamic acid (E) to aspartic acid (D) amino acid substitution. Non-conserved substitutions consist of replacing one or more amino acids of the DP107 (SEQ ID NO:16) peptide sequence with amino acids possessing dissimilar charge, size, and/or hydrophobicity characteristics, such as, for example, a glutamic acid (E) to valine (V) substitution.

Amino acid insertions may consist of single amino acid residues or stretches of residues. The insertions may be made at the carboxy or amino terminal end of the DP107 or DP107 truncated peptides, as well as at a position internal to the peptide. Such insertions will generally range from 2 to 15 amino acids in length. It is contemplated that insertions made at either the carboxy or amino terminus of the peptide of interest may be of a broader size range, with about 2 to about 50 amino acids being preferred. One or more such insertions may be introduced into DP107 (SEQ.ID NO:16) or DP107 truncations, as long as such insertions result in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures.

Preferred amino or carboxy terminal insertions are peptides ranging from about 2 to about 50 amino acid residues in length, corresponding to gp41 protein regions either amino to or carboxy to the actual DP107 gp41 amino acid sequence, respectively. Thus, a preferred amino terminal or carboxy terminal amino acid insertion would contain gp41 amino acid sequences found immediately amino to or carboxy to the DP107 region of the gp41 protein.

Deletions of DP107 (SEQ ID NO:16) or DP178 truncations are also within the scope of the invention. Such deletions consist of the removal of one or more amino acids from the DP107 or DP107-like peptide sequence, with the lower limit length of the resulting peptide sequence being 4 to 6 amino acids. Such deletions may involve a single contiguous or greater than one discrete portion of the peptide sequences. One or more such deletions may be introduced into DP107 (SEQ.ID NO:16) or DP107 truncations, as long as such deletions result in peptides which may still be recognized by the 107×178×4, ALLMOTI5 or PLZIP search motifs described herein, or may, alternatively, exhibit antifusogenic or antiviral activity, or exhibit the ability to modulate intracellular processes involving coiled-coil peptide structures.

DP107 and DP107 truncations are more fully described in U.S. Pat. No. 5,646,480, issued Aug. 12, 1997, and which is incorporated herein by reference in its entirety. DP107 analogs are further described, below, in Section 5.3.

5.3. DP107 and DP178 Analogs

Peptides corresponding to analogs of the DP178, DP178 truncations, DP107 and DP107 truncation sequences of the invention, described, above, in Sections 5.1 and 5.2 may be found in other viruses, including, for example, non-HIV-$1_{LAI}$ enveloped viruses, non-enveloped viruses and other non-viral organisms.

The term "analog", as used herein, refers to a peptide which is recognized or identified via the 107×178×4, ALLMOTI5 and/or PLZIP search strategies discussed below. Further, such peptides may exhibit antifusogenic capability, antiviral activity, or the ability to modulate intracellular processes involving coiled-coil structures.

Such DP178 and DP107 analogs may, for example, correspond to peptide sequences present in TM proteins of enveloped viruses and may, additionally correspond to peptide sequences present in non enveloped and non-viral organisms. Such peptides may exhibit antifusogenic activity, antiviral activity, most particularly antiviral activity which is specific to the virus in which their native sequences are found, or may exhibit an ability to modulate intracellular processes involving coiled-coil peptide structures.

DP178 analogs are peptides whose amino acid sequences are comprised of the amino acid sequences of peptide regions of, for example, other (i.e., other than HIV-$1_{LAI}$) viruses that correspond to the gp41 peptide region from which DP178 (SEQ ID NO:15) was derived. Such viruses may include, but are not limited to, other HIV-1 isolates and HIV-2 isolates. DP178 analogs derived from the corresponding gp41 peptide region of other (i.e., non HIV-$1_{LAI}$) HIV-1 isolates may include, for example, peptide sequences as shown below.

$NH_2$-YTNTIYTLLEESQNQQEKNEQELLELDKWASLWNWF-COOH (DP-185; SEQ ID NO:1357);

$NH_2$-YTGIIYNLLEESQNQQEKNEQELLELDKWANLWNWF-COOH (SEQ ID NO:1358);

$NH_2$-YTSLIYSLLEKSQIQQEKNEQELLELDKWASLWNWF-COOH (SEQ ID NO:1553).

SEQ ID NO:1357 (DP-185), SEQ ID NO:1358, and SEQ ID NO:1553 are derived from HIV-$1_{SF2}$, HIV-$1_{RF}$, and HIV-$1_{MN}$ isolates, respectively. Underlined amino acid residues refer to those residues that differ from the corresponding position in the DP178 (SEQ ID NO:15) peptide. One such DP178 analog, DP-185 (SEQ ID NO:1357), is described in the Example presented in Section 6, below, where it is demonstrated that DP-185 (SEQ ID NO:1357) exhibits antiviral activity. The DP178 analogs of the invention may also include truncations, as described above. Further, the analogs of the invention include modifications, such as those described for DP178 analogs in Section 5.1., above. It is preferred that the DP178 analogs of the invention represent peptides whose amino acid sequences correspond to the DP178 region of the gp41 protein, it is also contemplated that the peptides of the invention may, additionally, include amino sequences, ranging from about 2 to about 50 amino acid residues in length, corresponding to gp41 protein regions either amino to or carboxy to the actual DP178 amino acid sequence.

Striking similarities, as shown in FIG. 1, exist within the regions of HIV-1 and HIV-2 isolates which correspond to the DP178 sequence. A DP178 analog derived from the HIV-$2_{NIHZ}$ isolate has the 36 amino acid sequence (reading from amino to carboxy terminus):

$NH_2$-LEANISQSLEQAQIQQEKNMYELQKLNSWDVFTNWL-COOH (SEQ ID NO:1555)

Table III and Table IV show some possible truncations of the HIV-$2_{NIHZ}$ DP178 analog, which may comprise peptides of between 3 and 36 amino acid residues (i.e., peptides ranging in size from a tripeptide to a 36-mer polypeptide). Peptide sequences in these tables are listed from amino (left)

to carboxy (right) terminus. "X" may represent an amino group (—NH$_2$) and "Z" may represent a carboxyl (—COOH) group. Alternatively, "X" may represent a hydrophobic group, including but not limited to carbobenzyl, dansyl, or T-butoxycarbonyl; an acetyl group; a 9-fluorenylmethoxy-carbonyl (FMOC) group; or a covalently attached macromolecular group, including but not limited to a lipid-fatty acid conjugate, polyethylene glycol, carbohydrate or peptide group. Further, "Z" may represent an amido group; a T-butoxycarbonyl group; or a covalently attached macromolecular group, including, but not limited to a lipid-fatty acid conjugate, polyethylene glycol, carbohydrate or peptide group. A preferred "X" or "Z" macromolecular group is a peptide group.

TABLE III

HIV-2$_{NIHZ}$ DP178 ANALOG (SEQ ID NO:1555)CARBOXY TRUNCATIONS*

X-LEA-Z
X-LEAN-Z
X-LEANI-Z
X-LEANIS-Z
X-LEANISQ-Z
X-LEANISQS-Z
X-LEANISQSL-Z
X-LEANISQSLE-Z
X-LEANISQSLEQ-Z
X-LEANISQSLEQA-Z
X-LEANISQSLEQAQ-Z
X-LEANISQSLEQAQI-Z
X-LEANISQSLEQAQIQ-Z
X-LEANISQSLEQAQIQQ-Z
X-LEANISQSLEQAQIQQE-Z
X-LEANISQSLEQAQIQQEK-Z
X-LEANISQSLEQAQIQQEKN-Z
X-LEANISQSLEQAQIQQEKNM-Z
X-LEANISQSLEQAQIQQEKNMY-Z
X-LEANISQSLEQAQIQQEKNMYE-Z
X-LEANISQSLEQAQIQQEKNMYEL-Z
X-LEANISQSLEQAQIQQEKNMYELQ-Z
X-LEANISQSLEQAQIQQEKNMYELQK-Z
X-LEANISQSLEQAQIQQEKNMYELQKL-Z
X-LEANISQSLEQAQIQQEKNMYELQKLN-Z
X-LEANISQSLEQAQIQQEKNMYELQKLNS-Z
X-LEANISQSLEQAQIQQEKNMYELQKLNSW-Z
X-LEANISQSLEQAQIQQEKNMYELQKLNSWD-Z
X-LEANISQSLEQAQIQQEKNMYELQKLNSWDV-Z
X-LEANISQSLEQAQIQQEKNMYELQKLNSWDVF-Z
X-LEANISQSLEQAQIQQEKNMYELQKLNSWDVFT-Z
X-LEANISQSLEQAQIQQEKNMYELQKLNSWDVFTN-Z
X-LEANISQSLEQAQIQQEKNMYELQKLNSWDVFTNW-Z
X-LEANISQSLEQAQIQQEKNMYELQKLNSWDVFTNWL-Z
(SEQ ID NOS:1555–1588, respectively)

(*The one-letter amino acid code is used.)

TABLE IV

HIV-2$_{NIHZ}$ DP178 ANALOG (SEQ ID NO:1555) AMINO TRUNCATIONS

X-NWL-Z
X-TNWL-Z
X-FTNWL-Z
X-VFTNWL-Z
X-DVFTNWL-Z
X-WDVFTNWL-Z
X-SWDVFTNWL-Z
X-NSWDVFTNWL-Z
X-LNSWDVFTNWL-Z
X-KLNSWDVFTNWL-Z
X-QKLNSWDVFTNWL-Z
X-LQKLNSWDVFTNWL-Z
X-ELQKLNSWDVFTNWL-Z
X-YELQKLNSWDVFTNWL-Z

TABLE IV-continued

HIV-2$_{NIHZ}$ DP178 ANALOG (SEQ ID NO:1555) AMINO TRUNCATIONS

X-MYELQKLNSWDVFTNWL-Z
X-NMYELQKLNSWDVFTNWL-Z
X-KNMYELQKLNSWDVFTNWL-Z
X-EKNMYELQKLNSWDVFTNWL-Z
X-QEKNMYELQKLNSWDVFTNWL-Z
X-QQEKNMYELQKLNSWDVFTNWL-Z
X-IQQEKNMYELQKLNSWDVFTNWL-Z
X-QIQQEKNMYELQKLNSWDVFTNWL-Z
X-AQIQQEKNMYELQKLNSWDVFTNWL-Z
X-QAQIQQEKNMYELQKLNSWDVFTNWL-Z
X-EQAQIQQEKNMYELQKLNSWDVFTNWL-Z
X-LEQAQIQQEKNMYELQKLNSWDVFTNWL-Z
X-SLEQAQIQQEKNMYELQKLNSWDVFTNWL-Z
X-QSLEQAQIQQEKNMYELQKLNSWDVFTNWL-Z
X-SQSLEQAQIQQEKNMYELQKLNSWDVFTNWL-Z
X-ISQSLEQAQIQQEKNMYELQKLNSWDVFTNWL-Z
X-NISQSLEQAQIQQEKNMYELQKLNSWDVFTNWL-Z
X-ANISQSLEQAQIQQEKNMYELQKLNSWDVFTNWL-Z
X-EANISQSLEQAQIQQEKNMYELQKLNSWDVFTNWL-Z
X-LEANISQSLEQAQIQQEKNMYELQKLNSWDVFTNWL-Z
(SEQ ID NOS:1589–1621 and 1555, respectively)

(*The one-letter amino acid code is used.)

DP178 and DP107 analogs are recognized or identified, for example, by utilizing one or more of the 107×178×4, ALLMOTI5 or PLZIP computer-assisted search strategies described and demonstrated, below, in the Examples presented in Sections 9 through 16 and 19 through 25. The search strategy identifies additional peptide regions which are predicted to have structural and/or amino acid sequence features similar to those of DP107 and/or DP178.

The search strategies are described fully, below, in the Example presented in Section 9. While this search strategy is based, in part, on a primary amino acid motif deduced from DP107 and DP178, it is not based solely on searching for primary amino acid sequence homologies, as such protein sequence homologies exist within, but not between major groups of viruses. For example, primary amino acid sequence homology is high within the TM protein of different strains of HIV-1 or within the TM protein of different isolates of simian immunodeficiency virus (SIV). Primary amino acid sequence homology between HIV-1 and SIV, however, is low enough so as not to be useful. It is not possible, therefore, to find peptide regions similar to DP107 or DP178 within other viruses, or within non-viral organisms, whether structurally, or otherwise, based on primary sequence homology, alone.

Further, while it would be potentially useful to identify primary sequence arrangements of amino acids based on, for example, the physical chemical characteristics of different classes of amino acids rather than based on the specific amino acids themselves, such search strategies have, until now, proven inadequate. For example, a computer algorithm designed by Lupas et al. to identify coiled-coil propensities of regions within proteins (Lupas, A., et al., 1991 Science 252:1162–1164) is inadequate for identifying protein regions analogous to DP107 or DP178.

Specifically, analysis of HIV-1 gp160 (containing both gp120 and gp41) using the Lupas algorithm does not identify the coiled-coil region within DP107. It does, however, identify a region within DP178 beginning eight amino acids N-terminal to the start of DP178 and ending eight amino acids from the C-terminus. The DP107 peptide has been shown experimentally to form a stable coiled coil. A search based on the Lupas search algorithm, therefore, would not have identified the DP107 coiled-coil region. Conversely, the Lupas algorithm identified the DPI 78 region as a potential coiled-coil motif. However, the peptide derived from the DP178 region failed to form a coiled coil in solution.

A possible explanation for the inability of the Lupas search algorithm to accurately identify coiled-coil sequences within the HIV-1 TM, is that the Lupas algorithm is based on the structure of coiled coils from proteins that are not structurally or functionally similar to the TM proteins of viruses, antiviral peptides (e.g. DP107 and DP178) of which are an object of this invention.

The computer search strategy of the invention, as demonstrated in the Examples presented below, in Sections 9 through 16 and 19 through 25, successfully identifies regions of proteins similar to DP107 or DP178. This search strategy was designed to be used with a commercially-available sequence database package, preferably PC/Gene.

A series of search motifs, the 107×178×4, ALLMOTI5 and PLZIP motifs, were designed and engineered to range in stringency from strict to broad, as discussed in this Section and in Section 9, with 107×178×4 being preferred. The sequences identified via such search motifs, such as those listed in Tables V–XIV, below, potentially exhibit antifusogenic, such as antiviral, activity, may additionally be useful in the identification of antifusogenic, such as antiviral, compounds, and are intended to be within the scope of the invention.

Coiled-coiled sequences are thought to consist of heptad amino acid repeats. For ease of description, the amino acid positions within the heptad repeats are sometimes referred to as A through G, with the first position being A, the second B, etc. The motifs used to identify DP107-like and DP178-like sequences herein are designed to specifically search for and identify such heptad repeats. In the descriptions of each of the motifs described, below, amino acids enclosed by brackets, i.e., [ ], designate the only amino acid residues that are acceptable at the given position, while amino acids enclosed by braces, i.e., { }, designate the only amino acids which are unacceptable at the given heptad position. When a set of bracketed or braced amino acids is followed by a number in parentheses i.e., ( ), it refers to the number of subsequent amino acid positions for which the designated set of amino acids hold, e.g, a (2) means "for the next two heptad amino acid positions".

The ALLMOTI5 is written as follows:

{CDGHP}-{CFP}(2)-{CDGHP}-{CFP}(3)-
{CDGHP}-{CFP}(2)-{CDGHP}-{CFP}(3)-
{CDGHP}-{CFP}(2)-{CDGHP}-{CFP}(3)-
{CDGHP}-{CFP}(2)-{CDGHP}-{CFP}(3)-
{CDGHP}-{CFP}(2)-{CDGHP}-{CFP}(3)-
{CDGHP}-{CFP}(2)-{CDGHP}-{CFP}(3)-

Translating this motif, it would read: "at the first (A) position of the heptad, any amino acid residue except C, D, G, H, or P is acceptable, at the next two (B,C) amino acid positions, any amino acid residue except C, F, or P is acceptable, at the fourth heptad position (D), any amino acid residue except C, D, G, H, or P is acceptable, at the next three (E, F, G) amino acid positions, any amino acid residue except C, F, or P is acceptable. This motif is designed to search for five consecutive heptad repeats (thus the repeat of the first line five times), meaning that it searches for 35-mer sized peptides. It may also be designed to search for 28-mers, by only repeating the initial motif four times. With respect to the ALLMOTI5 motif, a 35-mer search is preferred. Those viral (non-bacteriophage) sequences identified via such an ALLMOTI5 motif are listed in Table V in U.S. patent application Ser. No. 08/470,896 filed on Jun. 6, 1995 which is incorporated herein by reference in its entirety. These viral sequences potentially exhibit antiviral activity, may be useful in the the identification of antiviral compounds, and are intended to be within the scope of the invention. In those instances wherein a single gene exhibits greater than one sequence recognized by the ALLMOTI5 search motif, the amino a cid residue numbers of these sequences are listed under "Area 2", Area 3", etc. This convention is used for each of the Tables listed, below, at the end of this Section.

The 107×178×4 motif is written as follows:

[EFIKLNQSTVWY]-{CFMP}(2)-[EFIKLNQSTVWY]-{CFMP}(3)-
[EFIKLNQSTVWY]-{CFMP}(2)-[EFIKLNQSTVWY]-{CFMP}(3)-
[EFIKLNQSTVWY]-{CFMP}(2)-[EFIKLNQSTVWY]-{CFMP}(3)-
[EFIKLNQSTVWY]-{CFMP}(2)-[EFIKLNQSTVWY]-{CFMP}(3)-
[EFIKLNQSTVWY]-{CFMP}(2)-[EFIKLNQSTVWY]-{CFMP}(3)-

Translating this motif, it would read: "at the first (A) position of the heptad, only amino acid residue E, F, I, K, L, N, Q, S, T, V, W, or Y is acceptable, at the next two (B,C) amino acid positions, any amino acid residue except C, F, M or P is acceptable, at the fourth position (D), only amino acid residue E, F, I, K, L, N, Q, S, T, V, W, or Y is acceptable, at the next three (E, F, G) amino acid positions, any amino acid residue except C, F, M or P is acceptable. This motif is designed to search for four consecutive heptad repeats (thus the repeat of the first line four times), meaning that it searches for 28-mer sized peptides. It may also be designed to search for 35-mers, by repeating the initial motif five times. With respect to the 107×178×4 motif, a 28-mer search is preferred.

Those viral (non-bacteriophage) sequences identified via such a 107×178×4 motif are listed in Table VI in U.S. patent application Ser. No. 08/470,896 filed on Jun. 6, 1995, which is incorporated herein, by reference, in its entirety. Those viral (non-bacteriophage) sequences listed in Table VII of U.S. patent application Ser. No. 08/470,896 (incorporated herein by reference in its entirety) are particularly preferred.

The 107×178×4 search motif was also utilized to identify non-viral procaryotic protein sequences, as listed in Table VIII in U.S. patent application Ser. No. 08/470,896 filed on Jun. 6, 1995, which is incorporated herein, by reference, in its entirety. Further, this search motif was used to reveal a number of human proteins. The results of this human protein 107×178×4 search is listed in Table IX in U.S. patent application Ser. No. 08/470,896 filed on Jun. 6, 1995, which is incorporated herein, by reference, in its entirety. The sequences listed in Tables VIII and IX, therefore, reveal peptides which may be useful as antifusogenic compounds or in the identification of antifusogenic compounds, and are intended to be within the scope of the invention.

The PLZIP series of motifs are as listed in FIG. 19. These motifs are designed to identify leucine zipper coiled-coil like heptads wherein at least one proline residue is present at some predefined distance N-terminal to the repeat. These PLZIP motifs find regions of proteins with similarities to HIV-1 DP178 generally located just N-terminal to the transmembrane anchor. These motifs may be translated according to the same convention described above. Each line depicted in FIG. 19 represents a single, complete search motif. "X" in these motifs refers to any amino acid residue. In instances wherein a motif contains two numbers within parentheses, this refers to a variable number of amino acid residues. For example, X (1,12) is translated to "the next one to twelve amino acid residues, inclusive, may be any amino acid".

Tables X through XIV in U.S. patent application Ser. No. 08/485,264 filed on Jun. 7, 1995 (which is incorporated herein, by reference, in its entirety), list sequences identified via searches conducted with such PLZIP motifs. Specifically, Table X lists viral sequences identified via PCTLZIP, P1CTLZIP and P2CTLZIP search motifs, Table XI lists viral sequences identified via P3CTLZIP, P4CTLZIP, P5CTLZIP and P6CTLZIP search motifs, Table XII lists viral sequences identified via P7CTLZIP, P8CTLZIP and P9CTLZIP search motifs, Table XIII lists viral sequences identified via P12LZIPC searches and Table XIV lists viral sequences identified via P23TLZIPC search motifs The viral sequences listed in these tables represent peptides which potentially exhibit antiviral activity, may be useful in the identification of antiviral compounds, and are intended to be within the scope of the invention.

The DP107 and DP178 analogs may, further, contain any of the additional groups described for DP178, above, in Section 5.1. For example, these peptides may include any of the additional amino-terminal groups as described above for "X" groups, and may also include any of the carboxy-terminal groups as described, above, for "Z" groups.

Additionally, truncations of the identified DP107 and DP178 peptides are among the peptides of the invention. Further, such DP107 and DP178 analogs and DP107/DP178 analog truncations may exhibit one or more amino acid substitutions, insertion, and/or deletions. The DP178 analog amino acid substitutions, insertions and deletions, are as described, above, for DP178-like peptides in Section 5.1. The DP-107 analog amino acid substitutions, insertions and deletions are also as described, above, for DP107-like peptides in Section 5.2. Representative examples of such DP107/DP178 truncations are provided in Tables XV through XXII of U.S. patent application Ser. No. 08/470,896 filed on Jun. 6, 1995, which is incorporated herein by reference in its entirety.

Other exemplary DP178 and DP107 peptides and DP178-like and DP107-like peptides include the peptides described in International Patent Publication No. WO 99/59615, published Nov. 25, 1999, which is incorporated by reference in its entirety. Such DP178 and DP107 peptides and DP178-like and DP107-like peptides include, e.g., the peptides listed below in Table V.

Other DP178, DP107, DP178-like and DP107-like peptides include peptides described, e.g., in U.S. Pat. No. 5,656,480, issued Aug. 12, 1997; in U.S. Pat. No. 5,464,933, issued Nov. 7, 1995; in International Patent Publication No. WO 94/28920, published on Dec. 22, 1994; and in International Patent Publication No. WO 96/19495, published on Jun. 27, 1996, each of which is incorporated herein by reference its entirety.

TABLE V

| T No. | Sequence | Seq. ID No. |
|---|---|---|
| 1 | GIKQLQARILAVERYLKDQ | 1 |
| 2 | NNLLRAIEAQQHLLQLTVW | 2 |
| 3 | NEQELLELDKWASLWNWF | 3 |
| 4 | YTSLIHSLIEESQNQQEK | 4 |
| 5 | Ac-VWGIKQLQARILAVERYLKDQQLLGIWG-NH2 | 5 |
| 6 | QHLLQLTVWGIKQLQARILAVERYLKDQ | 6 |
| 7 | LRAIEAQQHLLQLTVWGIKQLQARILAV | 7 |
| 8 | VQQQNNLLARIEAQQHLLQLTVWGIKQL | 8 |
| 9 | RQLLSGIVQQQNNLLRAIEAQQHLLQLT | 9 |
| 10 | MTLTVQARQLLSGIVQQQNNLLRAIEAQ | 10 |
| 12 | VVSLSNGVSVLTSKVLDLKNYIDKQLL | 11 |
| 13 | LLSTNKAVVSLSNGVSVLTSKVLDLKNY | 12 |
| 15 | Ac-VLHLEGEVNKIKSALLSTNKAVVSLSNG-NH2 | 13 |
| 19 | Ac-LLSTNKAVVSLSNGVSVLSTKVLDLKNY-NH2 | 14 |
| 20 | Ac-YTSLIHSLIEESQNQQEKNEQELLELDKWASLWNWF-NH2 | 15 |
| 21 | Ac-NNLLRAIEAQQHLLQLTVWGIKQLQARILAVERYLKDQ-NH2 | 16 |
| 22 | Ac-IELSNIKENKCNGTDAKVKLIKQELDKYKNAVTELQLLMQST-NH2 | 17 |
| 23 | Ac-IELSNIKENKCNGTDAKVKLIKQELDKY-NH2 | 18 |
| 24 | Ac-ENKCNGTDAKVKLIKQELDKYKNAVTEL-NH2 | 19 |
| 25 | Ac-DAKVKLIKQELDKYKNAVTELQLLMQST-NH2 | 20 |
| 26 | Ac-CNGTDAKVKLIKQELDKYKNAVTELQLL-NH2 | 21 |
| 27 | Ac-SNIKENKCNGTDAKVKLIKQELDKYKNAVTELQLL-NH2 | 22 |
| 28 | Ac-ASGVAVSKVLHLEGEVNKIKSALLSTNAVVSLSNGV-NH2 | 23 |
| 29 | Ac-SGVAVSKVLHLEGEVNKIKSALLSTNKAVVSLSNG-NH2 | 24 |
| 30 | Ac-VLHLEGEVNKIKSALLSTHKAVVSLSNGVSVLTSK-NH2 | 25 |
| 31 | Ac-ARKLQRMKQLEDKVEELLSKNYHYLENEVARLKKLV-NH2 | 26 |
| 32 | Ac-RMKQLEDKVEELLSKNYHYLENEVARLKKLVGER-NH2 | 27 |
| 33 | Ac-VQQQNNLLRAIEAQQHLLQLTVWGIKQL-NH2 | 28 |
| 34 | Ac-LRAIEAQQHLLQLTVWGIKQLQARILAV-NH2 | 29 |
| 35 | Ac-QHLLQLTVWGLKQLQARILAVERYLKDQ-NH2 | 30 |
| 36 | Ac-RQLLSGIVQQQNNLLRAIEAQQHLLQLT-NH2 | 31 |
| 37 | Ac-MTLTVQARQLLSGIVQQQNNLLRAIEAQ-NH2 | 32 |
| 38 | Ac-AKQARSDIEKLKEAIRDTNKAVQSVQSS-NH2 | 33 |
| 39 | Ac-AAVALVEAKQARSDIEKLKEAIRDTNAVQSVQSS-NH2 | 34 |
| 40 | Ac-AKQARSDIEKLKEAIRDTNKAVQSSIGNLIVA-NH2 | 35 |
| 41 | Ac-GTIALGVATSAQITAAVALVEAKQARSD-NH2 | 36 |
| 42 | Ac-ATSAQITAAVALVEAKQARSDIEKLKEA-NH2 | 37 |
| 43 | Ac-AAVALVEAKQARSDIEKLKEAIRDTNKANH2 | 38 |
| 44 | Ac-IEKLKEAIRDTNKAVQSVQSSIGNLIVA-NH2 | 40 |
| 45 | Ac-IRDTNKAVQSVQSSIGNLIVAIKSVQDY-NH2 | 41 |
| 46 | Ac-AVQSVQSSIGNLIVAIKSVQDYVNKEIV-NH2 | 42 |
| 47 | Ac-QARQLLSGIVQQQNNLLRAIEAQQHLLQLTVWGIKQLARILAVERYLKDQ-NH2 | 43 |

TABLE V-continued

| T No. | Sequence | Seq. ID No. |
|---|---|---|
| 48 | Ac-QARQLLSGIVQQQNNLLRAIEAQQHLLQ-NH2 | 44 |
| 49 | Ac-MTWMEMDREINNYTSLIGSLIEESQNQQEKNEQELLELDKWASLWNWF-NH2 | 45 |
| 50 | Ac-WMEWDREINNYTSLIGSLIEESQNQQEKNEQELLE-NH2 | 46 |
| 51 | Ac-INNYTSLIGSLIEESQNQQEKNEQELLE-NH2 | 47 |
| 52 | Ac-INNYTSLIGSLIEESQNQQEKNEQELLELDKWASL-NH2 | 48 |
| 53 | Ac-EWDREINNYTSLIGSLIEESQNQQEKNEQEGGC-NH2 | 49 |
| 54 | Ac-QSRTLLAGIVQQQQQLLDVKKRQQELLR-NH2 | 50 |
| 55 | Ac-NNDTWQEWERKVDFLEENITALLEEAQIQQEKNMYELQKLNSWD-NH2 | 51 |
| 56 | Ac-WQEWERKVDFLEENITALLEEAQIQQEK-NH2 | 52 |
| 57 | Ac-VDFLEENITALLEEAQIQQEKNMYELQK-NH2 | 53 |
| 58 | Ac-ITALLEEAQIQQEKNMYELQKLNSWDVF-NH2 | 54 |
| 59 | Ac-SSESFTLLEQWNNWKLQLAEQWLEQINEKHYLEDIS-NH2 | 55 |
| 60 | Ac-DKWASLWNWF-NH2 | 56 |
| 61 | Ac-NEQELLELDKWASLWNWF-NH2 | 57 |
| 62 | Ac-EKNEQELLELDKWASLWNWF-NH2 | 58 |
| 63 | Ac-NQQEKNEQELLELDKWASLWNWF-NH2 | 59 |
| 64 | Ac-ESQNQQEKNEQELLELDKWASLWNWF-NH2 | 60 |
| 65 | Ac-LIHSLIEESQNQQEKNEQELLELDKWASLWNWF-NH2 | 61 |
| 66 | Ac-NDQKKLMSNNVQIVRQQSYSIMSIIKEE-NH2 | 62 |
| 67 | Ac-DEFDASISQVNEKINQSLAFIRKSDELL-NH2 | 63 |
| 68 | Ac-VSKGYSALRTGWYTSVITIELSNIKEN-NH2 | 64 |
| 69 | Ac-VVSLSNGVSVLTSKVLDLKNYIDKQLL-NH2 | 65 |
| 70 | Ac-VNKIKSALLSTNKAVVSLSNGVSVLTSK-NH2 | 66 |
| 71 | Ac-PIINFYDPLVFPSDEFDASISQVNEKINQSLAFIR-NH2 | 67 |
| 72 | Ac-NLVYAQLQFTYDTLRGYINRALAQIAEA-NH2 | 68 |
| 73 | Ac-LNQVDLTETLERYQQRLNTYALVSKDASYRS-NH2 | 69 |
| 74 | Ac-ELLVLKKAQLNRHSYLKDSDFLDAALD-NH2 | 70 |
| 75 | Ac-LAEAGEESVTEDTEREDTEEEREDEEE-NH2 | 71 |
| 76 | Ac-ALLAEAGEESVTEDTEREDTEEEREDEEEENEART-NH2 | 72 |
| 77 | Ac-ETERSVDLVAALLAEAGEESVTEDTEREDTEEERE-NH2 | 73 |
| 78 | Ac-EESVTEDTEREDTEEEREDEEEENEART-NH2 | 74 |
| 79 | Ac-VDLVAALLAEAGEESVTEDTEREDTEEE-NH2 | 75 |
| 80 | Ac-NSETERSVDLVAALLAEAGEESVTE-NH2 | 76 |
| 81 | Ac-DISYAQLQFTYDVLKDYINDALRNIMDA-NH2 | 77 |
| 82 | Ac-SNVFSKDEIMREYNSQKQHIRTLSAKVNDN-NH2 | 78 |
| 83 | Biotin-YTSLIHSLIEESQNQQEKNEQELLELDKWASLWNWF-NH2 | 1076 |
| 84 | Dig-YTSLIHSLIEESQNQQEKNEQELLELDKWASLWNWF-NH2 | 1076 |
| 85 | Biotin-NNLLRAIEAQQHLLQLTVWGIKQLQARILAVERYLKDQ-NH2 | 16 |
| 86 | Dig-NNLLRAIEAQQHLLQLTVWGIKQLQARILAVERYLKDQ-NH2 | 16 |
| 87 | Ac-VLHQLNIQLKQYLETQERLLAGNRIAARQLLQIWKDVA-NH2 | 83 |
| 88 | Ac-LWHEQLLNTAQRAGLQLQLINQALAVREKVLIRYDIQK-NH2 | 84 |
| 89 | Ac-LLDNFESTWEQSKELWEQQEISIQNLHKSALQEYW-NH2 | 85 |
| 90 | Ac-LSNLLQISNNSDEWLEALEIEHEKWKLTQWQSYEQF-NH2 | 86 |
| 91 | Ac-KLEALEGKLEALEGKLEALEGKLEALEGKLEALEGK-NH2 | 87 |
| 92 | Ac-ELRALRGELRALRGELRALRGELRALRGK-NH2 | 88 |
| 93 | Ac-ELKAKELEGEGLAEGEEALKGLLEKAAKLEGLELLK-NH2 | 89 |
| 94 | Ac-WEAAAREAAAREAAAREAAARA-NH2 | 90 |
| 95 | Ac-YTSLIHSLIEESQNQQEKNEQELLELDKWASLWNAF-NH2 | 91 |
| 96 | Ac-YTSLIHSLIEESQNQQEKNEQELLELDKWASLANWF-NH2 | 92 |
| 97 | Ac-YTSLIHSLIEESQNQQELLELDKWASLWNWF-NH2 | 93 |
| 98 | Ac-YTSLIHSLIEESQNQQEKNEQELLQLDKWASLWNWF-NH2 | 94 |
| 99 | Ac-YTSLIHSLIEESQNQQEKNQQELLQLDKWASLWNWF-NH2 | 95 |
| 100 | Ac-RMKQLEDKVEELLSKNYHLENEVARLKKLVGER-NH2 | 96 |
| 101 | Ac-QQLLQLTVWGIKQLQARILAVERYLKNQ-NH2 | 97 |
| 102 | Ac-NEQELLELDKWASLWNWF-NH2 | 98 |
| 103 | Ac-YTSLIQSLIEESQNQQEKNEQELLELDKWASLWNWF-NH2 | 99 |
| 104 | Ac-IINFYDPLVFPSDEFDASISQVNEKINQSLAFIRK-NH2 | 100 |
| 105 | Ac-INFYDPLVFPSDEFDASISQVNEKINQSLAFIRKS-NH2 | 101 |
| 106 | Ac-NFYDPLVFPSDEFDASISQVNEKINQSLAFIRKSD-NH2 | 102 |
| 107 | Ac-FYDPLVFPSDEFDASISQVNEKINQSLAFIRKSDE-NH2 | 103 |
| 108 | Ac-YDPLVFPSDEFDASISQVNEKINQSLAFLRKSDEL-NH2 | 104 |
| 109 | Ac-DPLVFPSDEFDASISQVNEKINQSLAFIRKSDELL-NH2 | 105 |
| 110 | Ac-PLVFPSDEFDASISQVNEKINQSLAFIPKSDELLH-NH2 | 106 |
| 111 | Ac-LVFPSDEFDASISQVNEKINQSLAFIKKSDELLHN-NH2 | 107 |
| 112 | Ac-VFPSDEFDASISQVNEKINQSLAFIRKSDELLHNV-NH2 | 108 |
| 113 | Ac-FPSDEFDASISQVNEKINQSLAFIRKSDELLHNVN-NH2 | 109 |
| 114 | Ac-PSDEFDASISQVNEKINQSLAFIRKSDELLHNVNA-NH2 | 110 |
| 115 | Ac-SDEFDASISQVNEKINQSLAFIRKSDELLHNVNAG-NH2 | 111 |
| 116 | Ac-DEFDASISQVNEKINQSLAFIRKSDELLHNVNAGK-NH2 | 112 |
| 117 | Ac-EFDASISQVNEKINQSLAFIRKSDELLHNVNAGKS-NH2 | 113 |
| 118 | Ac-FDASISQVNEKINQSLAFIRKSDELLHNVNAGKST-NH2 | 114 |
| 119 | Ac-DASISQVNEKINQSLAFIRKSDELLHNVNAGKSTT-NH2 | 115 |
| 120 | Ac-ASGVAVSKVLHLEGEVNKIKSALLSTNKAVVSLSN-NH2 | 116 |
| 121 | Ac-SGVAVSKVLHLEGEVNKIKSALLSTNKAVVSLSNG-NH2 | 117 |
| 122 | Ac-GVAVSKVLHLEGEVNKIKSALLSTKKAVVSLSNGV-NH2 | 118 |
| 123 | Ac-VAVSKVLHLEGEVNKIKSALLSTNKAVVSLSNGVS-NH2 | 119 |

TABLE V-continued

| T No. | Sequence | Seq. ID No. |
|---|---|---|
| 124 | Ac-AVSKVLHLEGEVNKIKSALLSTNKAVVSLSNGVSV-NH2 | 120 |
| 125 | Ac-VSKVLHLEGEVNKIKSALLSTNKAVVSLSNGVSVL-NH2 | 121 |
| 126 | Ac-SKVLHLEGEVNKIKSALLSTNKAVVSLSNGVSVLT-NH2 | 122 |
| 127 | Ac-KVLHLEGEVNKIKSALLSTNKAVVSLSNGVSVLTS-NH2 | 123 |
| 128 | Ac-VLHLEGEVNKIKSALLSTNKAVVSLSNGVSVLTSK-NH2 | 124 |
| 129 | Ac-LHLEGEVNKIKSALLSTNKAVVSLSNGVSVLTSKV-NH2 | 125 |
| 130 | Ac-HLEGEVNKIKSALLSTNKAVVSLSNGVSVLTSKVL-NH2 | 126 |
| 131 | Ac-LEGEVNKIKSALLSTNKAVVSLSNGVSVLTSKVLD-NH2 | 127 |
| 132 | Ac-EGEVNKIKSALLSTNKAVVSLSNGVSVLTSKVLDL-NH2 | 128 |
| 133 | Ac-GEVNKIKSALLSTNKAVVSLSNGVSVLTSKVLDLK-NH2 | 129 |
| 134 | Ac-EVNKIKSALLSTNKAVVSLSNGVSVLTSKVLDLKN-NH2 | 130 |
| 135 | Ac-VNKIKSALLSTNKAVVSLSNGVSVLTSKVLDLKNY-NH2 | 131 |
| 136 | Ac-NKIKSALLSTNKAVVSLSNGVSVLTSKVLDLKNYI-NH2 | 132 |
| 137 | Ac-KIKSALLSTNKAVVSLSNGVSVLTSKVLDLKNYID-NH2 | 133 |
| 138 | Ac-IKSALLSTNKAVVSLSNGVSVLTSKVLDLKNYIDK-NH2 | 134 |
| 139 | Ac-KSALLSTNKAVVSLSNGVSVLTSKVLDLKNYIDKQ-NH2 | 135 |
| 140 | Ac-SALLSTNKAVVSLSNGVSVLTSKVLDLKNYIDKQL-NH2 | 136 |
| 141 | Ac-ALLSTNKAVVSLSNGVSVLTSKVLDLKNYIDKQLL-NH2 | 137 |
| 142 | Ac-YTSVITIELSNIKENKCNGTDAKVKLIKQELDKYK-NH2 | 138 |
| 143 | Ac-TSVITIELSNIKENKCNGTDAKVKLIKQELDKYKN-NH2 | 139 |
| 144 | Ac-SVITIELSNIKENKCNGTDAKVKLIKQELDKYKNA-NH2 | 140 |
| 145 | Ac-VITIELSNIKENKCNGTDAKVKLIKQELDKYKNAV-NH2 | 141 |
| 146 | Ac-ITIELSNIKENKCNGTDAKVKLIKQELDKYKNAVT-NH2 | 142 |
| 147 | Ac-TIELSNIKENKCNGTDAKVKLIKQELDKYKNAVTE-NH2 | 143 |
| 148 | Ac-IELSNIKENKCNGTDAKVKLIKQELDKYKNAVTEL-NH2 | 144 |
| 149 | Ac-ELSNIKENKCNGTDAKVKLIKQELDKYKNAVTELQ-NH2 | 145 |
| 150 | Ac-LSNIKENKCNGTDAKVKLIKQELDKYKNAVTELQL-NH2 | 146 |
| 151 | Ac-SNIKENKCNGTDAKVKLIKQELDKYKNAVTELQLL-NH2 | 147 |
| 152 | Ac-NIKENKCNGTDAKVKLIKQELDKYKNAVTELQLLM-NH2 | 148 |
| 153 | Ac-IKENKCNGTDAKVKLIKQELDKYKNAVTELQLLMQ-NH2 | 149 |
| 154 | Ac-KENKCNGTDAKVKLIKQELDKYKNAVTELQLLMQS-NH2 | 150 |
| 155 | Ac-ENKCNGTDAKVKLIKQELDKYKNAVTELQLLMQST-NH2 | 151 |
| 156 | Ac-LLDNFESTWEQSKELWELQEISIQNLHKSALQEYWN-NH2 | 152 |
| 157 | Ac-ALGVATSAQITAAVALVEAKQARSDIEKLKEAIRD-NH2 | 153 |
| 158 | Ac-LGVATSAQITAAVALVEAKQARSDIEKLKEAIRDT-NH2 | 154 |
| 159 | Ac-GVATSAQITAAVALVEAKQARSDIEKLKEAIRDTN-NH2 | 155 |
| 160 | Ac-VATSAQITAAVALVEAKQARSDIEKLKEAIRDTNK-NH2 | 156 |
| 161 | Ac-ATSAQITAAVALVEAKQARSDIEKLKEAIRDTNKA-NH2 | 157 |
| 162 | Ac-TSAQITAAVALVEAKQARSDIEKLKEAIRDTNKAV-NH2 | 158 |
| 163 | Ac-SAQITAAVALVEAKQARSDIEKLKEAIRDTNKAVQ-NH2 | 159 |
| 164 | Ac-AQITAAVALVEAKQARSDIEKLKEAIRDTNKAVQS-NH2 | 160 |
| 165 | Ac-QITAAVALVEAKQARSDIEKLKEAIRDTNKAVQSV-NH2 | 161 |
| 166 | Ac-ITAAVALVEAKQARSDIEKLKEAIRDTNKAVQSVQ-NH2 | 162 |
| 167 | Ac-TAAVALVEAKQARSDIEKLKEAIRDTNKAVQSVQS-NH2 | 163 |
| 168 | Ac-AAVALVEAKQARSDIEKLKEAIRDTNKAVQSVQSS-NH2 | 164 |
| 169 | Ac-AVALVEAKQARSDIEKLKEAIRDTNKAVQSVQSSI-NH2 | 165 |
| 170 | Ac-VALVEAKQARSDIEKLKEAIRDTNKAVQSVQSSIG-NH2 | 166 |
| 171 | Ac-ALVEAKQARSDIEKLKEAIRDTNKAVQSVQSSIGN-NH2 | 167 |
| 172 | Ac-LVEAKQARSDIEKLKEAIRDTNKAVQSVQSSIGNL-NH2 | 168 |
| 173 | Ac-VEAKQARSDIEKLKEAIRDTNKAVQSVQSSIGNLI-NH2 | 169 |
| 174 | Ac-EAKQARSDIEKLKEAIRDTNKAVQSVQSSIGNLIV-NH2 | 170 |
| 175 | Ac-KQARSDIEKLKEAIRDTNKAVQSVQSSIGNLIVAI-NH2 | 171 |
| 176 | Ac-QARSDIEKLKEAIRDTNKAVQSVQSSIGNLIVAIK-NH2 | 173 |
| 177 | Ac-ARSDIEKLKEAIRDTNKAVQSVQSSIGNLIVAIKS-NH2 | 174 |
| 178 | Ac-RSDIEKLKEAIRDTNKAVQSVQSSIGNLIVAIKSV-NH2 | 175 |
| 179 | Ac-SDIEKLKEAIRDTNKAVQSVQSSIGNLIVAIKSVQ-NH2 | 176 |
| 180 | Ac-DIEKLKEAIRDTNKAVQSVQSSIGNLIVAIKSVQD-NH2 | 177 |
| 181 | Ac-IEKLKEAIRDTNKAVQSVQSSIGNLIVAIKSVQDY-NH2 | 178 |
| 182 | Ac-EKLKEAIRDTNKAVQSVQSSIGNLIVAIKSVQDYV-NH2 | 179 |
| 183 | Ac-KLKEAIRDTNKAVQSVQSSIGNLIVAIKSVQDYVN-NH2 | 180 |
| 184 | Ac-LKEAIRDTNKAVQSVQSSIGNLIVAIKSVQDYVNK-NH2 | 181 |
| 185 | Ac-KEAIRDTNKAVQSVQSSIGNLIVAIKSVQDYVNKE-NH2 | 182 |
| 186 | Ac-EAIRDTNKAVQSVQSSIGNLIVAIKSVQDYNNKEI-NH2 | 183 |
| 187 | Ac-AIRDTNKAVQSVQSSIGNLIVAIKSVQDYVNKEIV-NH2 | 184 |
| 188 | Ac-IRDTNKAVQSVQSSIGNLIVAIKSVQDYVNKEIV-NH2 | 185 |
| 189 | Ac-YTPNDITLNNSVALDPIDISIELNKAKSDLEESKE-NH2 | 186 |
| 190 | Ac-TPNDITLNNSVALDPIDISIELNKAKSDLEESKEW-NH2 | 187 |
| 191 | Ac-PNDITLNNSVALDPIDISIELNKAKSDLEESKEWI-NH2 | 188 |
| 192 | Ac-NDITLNNSVALDPIDISIELNKAKSDLEESKEWIR-NH2 | 189 |
| 193 | Ac-DITLNNSVALDPIDISIELNKAKSDLEESKEWIRR-NH2 | 190 |
| 194 | Ac-ITLNNSVALDPIDISIELNKAKSDLEESKEWIRRS-NH2 | 191 |
| 195 | Ac-TLNNSVALDPIDISIELNKAKSDLEESKEWIRRSN-NH2 | 192 |
| 196 | Ac-LNNSVALDPIDISIELNKAKSDLEESKEWIRRSNQ-NH2 | 193 |
| 197 | Ac-NNSVALDPIDISIELNKAKSDLEESKEWIRRSNQK-NH2 | 194 |
| 198 | Ac-NSVALDPIDISIELNKAKSDLEESKEWIRRSNQKL-NH2 | 195 |
| 200 | Ac-SVALDPIDISIELNKAKSDLEESKEWLRRSNQKLD-NH2 | 196 |

TABLE V-continued

| T No. | Sequence | Seq. ID No. |
|---|---|---|
| 201 | Ac-VALDPIDISIELNKAKSDLEESKEWIRRSNQKLDS-NH2 | 197 |
| 202 | Ac-ALDPIDISIELNKAKSDLEESKEWIRRSNQKLDSI-NH2 | 198 |
| 203 | Ac-LDPIDISIELNKAKSDLEESKEWIRRSNQKLDSIG-NH2 | 199 |
| 204 | Ac-DPIDISIELNKAKSDLEESKEWIRRSNQKLDSIGN-NH2 | 200 |
| 205 | Ac-PIDISIELNKAKSDLEESKEWIRRSNQKLDSIGNW-NH2 | 201 |
| 206 | Ac-IDISIELNKAKSDLEESKEWIRRSNQKLDSIGNWH-NH2 | 202 |
| 207 | Ac-DISIELNKAKSDLEESKEWIRRSNQKLDSIGNWHQ-NH2 | 203 |
| 208 | Ac-ISIELNKAKSDLEESKEWIRRSNQKLDSIGNWHQS-NH2 | 204 |
| 209 | Ac-SIELNKAKSDLEESKEWIRRSNQKLDSIGNWHQSS-NH2 | 205 |
| 210 | Ac-IELNKAKSDLEESKEWIRRSNQKLDSIGNWHQSST-NH2 | 206 |
| 211 | Ac-ELNKAKSDLEESKEWIRRSNQKLDSIGNWHQSSTT-NH2 | 207 |
| 212 | Ac-ELRALRGELRALRGELRALRGELRALRGELRALRGK-NH2 | 208 |
| 213 | Ac-YTSLIHSLIEESQNQQQKNEQELLELDKWASLWNWF-NH2 | 209 |
| 214 | Ac-YTSLIHSLIEESQNQQEKNEQELLELNKWASLWNWF-NH2 | 210 |
| 215 | Ac-YTSLIHSLIEQSQNQQEKNEQELLELDKWASLWNWF-NH2 | 211 |
| 216 | Ac-YTSLIHSLIQESQNQQEKNEQELLELDKWASLWNWF-NH2 | 212 |
| 217 | Ac-YTSLIHSLIQQSQNQQQKNQQQLLQLNKWASLWNWF-NH2 | 213 |
| 218 | Ac-EQELLELDKWASLWNWF-NH2 | 214 |
| 219 | Ac-QELLELDKWASLWNWF-NH2 | 215 |
| 220 | Ac-ELLELDKWASLWNWF-NH2 | 216 |
| 221 | Ac-LELDKWASLWNWF-NH2 | 218 |
| 222 | Ac-ELDKWASLWNWF-NH2 | 219 |
| 226 | Ac-WASLWNWF-NH2 | 223 |
| 227 | Ac-ASLWNWF-NH2 | 224 |
| 229 | Ac-YTSLIHSLIEESQNQQEKNEQELLELDKWASLANAA-NH2 | 226 |
| 230 | Ac-YTSLIHSLIEESQNQQEKNEQQLLELDKWASLWNWF-NH2 | 227 |
| 231 | Ac-YTSLIQSLIEESQNQQEKNQQELLELDKWASLWNWF-NH2 | 228 |
| 234 | Ac-EAAAREAAAREAAARLELDKWASLWNWF-NH2 | 231 |
| 236 | Ac-PSLRDPISAEISIQALSYALGGDINKVLEKLGYSG-NH2 | 233 |
| 237 | Ac-SLRDPISAEISIQALSYALGGDINKVLEKLGYSGG-NH2 | 234 |
| 238 | Ac-LRDPISAEISIQALSYALGGDINKVLEKLGYSGGD-NH2 | 235 |
| 239 | Ac-RDPISAEISIQALSYALGGDINKVLEKLGYSGGDL-NH2 | 236 |
| 240 | Ac-DPISAEISIQALSYALGGDINKVLEKLGYSGGDLL-NH2 | 237 |
| 241 | Ac-PISAEISIQALSYALGGDINKVLEKLGYSGGDLLG-NH2 | 238 |
| 242 | Ac-ISAEISIQALSYALGGDINKVLEKLGYSGGDLLGI-NH2 | 239 |
| 243 | Ac-SAEISIQALSYALGGDINKVLEKLGYSGGDLLGIL-NH2 | 240 |
| 244 | Ac-AEISIQALSYALGGDINKVLEKLGYSGGDLLGILE-NH2 | 241 |
| 245 | Ac-EISIQALSYALGGDINKVLEKLGYSGGDLLGILES-NH2 | 242 |
| 246 | Ac-ISIQALSYALGGDINKVLEKLGYSGGDLLGILESR-NH2 | 243 |
| 247 | Ac-SIQALSYALGGDINKVLEKLGYSGGDLLGILESRG-NH2 | 244 |
| 248 | Ac-IQALSYALGGDINKVLEKLGYSGGDLLGILESRGI-NH2 | 245 |
| 249 | Ac-QALSYALGGDINKVLEKLGYSGGDLLGILESRGIK-NH2 | 246 |
| 250 | Ac-ALSYALGGDINKVLEKLGYSGGDLLGILESRGIKA-NH2 | 247 |
| 251 | Ac-LSYALGGDNKVLEKLGYSGGDLLGILESRGIKAR-NH2 | 248 |
| 252 | Ac-PDAVYLHRIDLGPPISLERLDVGTNLGNALAKLED-NH2 | 249 |
| 253 | Ac-DAVYLHRIDLGPPISLERLDVGTNLGNAIAKLEDA-NH2 | 250 |
| 254 | Ac-AVYLHRIDLGPPISLERLDVGTNLGNAIAKLEDAK-NH2 | 251 |
| 255 | Ac-VYLHRIDLGPPISLERLDVGTNLGNAIAKLEDAKE-NH2 | 252 |
| 256 | Ac-YLHRIDLGPPISLERLDVGTNLGNAIAKLEDAKEL-NH2 | 253 |
| 257 | Ac-LHRIDLGPPISLERLDVGTNLGNAIAKLEDAKELL-NH2 | 254 |
| 258 | Ac-HRIDLGPPISLERLDVGTNLGNAIAKLEDAKELLE-NH2 | 255 |
| 259 | Ac-RIDLGPPISLERLDVGTNLGNAIAKLEDAKELLES-NH2 | 256 |
| 260 | Ac-IDLGPPISLERLDVGTNLGNAIAKLEDAKELLESS-NH2 | 257 |
| 261 | Ac-DLGPPISLERLDVGTNLGNAIAKLEDAKELLESSD-NH2 | 258 |
| 262 | Ac-LGPPISLERLDVGTNLGNAIAKLEDAKELLESSDQ-NH2 | 259 |
| 263 | Ac-GPPISLERLDVGTNLGNAIAKLEDAKELLESSDQI-NH2 | 260 |
| 264 | Ac-PPISLERLDVGTNLGNAIAKLEDAKELLESSDQIL-NH2 | 261 |
| 265 | Ac-PISLERLDVGTNLGNAIAKLEDAKELLESSDQILR-NH2 | 262 |
| 266 | Ac-ISLERLDVGTNLGNAIAKLEDAKELLESSDQILRS-NH2 | 263 |
| 267 | Ac-SLERLDVGTNLGNAIAKLEDAKELLESSDQILRSM-NH2 | 264 |
| 268 | Ac-LERLDVGTNLGNAIAKLEDAKELLESSDQILRSMK-NH2 | 265 |
| 269 | Ac-EWIRRSNQKLDSI-NH2 | 266 |
| 270 | Ac-LELDKWASLANAF-NH2 | 267 |
| 271 | Ac-LELDKWASLFNFF-NH2 | 268 |
| 272 | Ac-LELDKWASLANWF-NH2 | 269 |
| 273 | Ac-LELDKWASLWNAF-NH2 | 270 |
| 274 | Ac-ELGNVNNSISNALDKLEESNSKLDKVNVKLTSTSA-NH2 | 271 |
| 275 | Ac-TELGNVNNSISNALDKLEESNSKLDKVNVKLTSTS-NH2 | 282 |
| 276 | Ac-STELGNVNNSISNALDKLEESNSKLDKVNVKLTST-NH2 | 273 |
| 277 | Ac-ISTELGNVNNSISNALDKLEESNSKLDKVNVKLTS-NH2 | 274 |
| 278 | Ac-DISTELGNNNNSISNALDKLEESNSKLDKVNVKLT-NH2 | 275 |
| 279 | Ac-LDISTELGNVNNSISNALDKLEESNSKLDKVNVKL-NH2 | 276 |
| 280 | Ac-NLDISTELGNVNNSISNALDKLEESNSKLDKVNVK-NH2 | 277 |
| 281 | Ac-GNLDISTELGNVNNSISNALDKLEESNSKLDKVNV-NH2 | 278 |
| 282 | Ac-TGNLDISTELGNVNNSISNALDKLEESNSKLDKVN-NH2 | 279 |
| 283 | Ac-VTGNLDISTELGNVNNSISNALDKLEESNSKLDKV-NH2 | 280 |

TABLE V-continued

| T No. | Sequence | Seq. ID No. |
|---|---|---|
| 284 | Ac-IVTGNLDISTELGNNNNSISNALDKLEESNSKLDK-NH2 | 281 |
| 285 | Ac-VIVTGNLDISTELGNVNNSISNALDKLEESNSKLD-NH2 | 282 |
| 286 | Ac-QVIVTGNLDISTELGNVNNSISNALDKLEESNSKL-NH2 | 283 |
| 287 | Ac-SQVIVTGNLDISTELGNNNNSISNALDKLEESNSK-NH2 | 284 |
| 288 | Ac-DSQVIVTGNLDISTELGNVNNSISNALDKLEESNS-NH2 | 285 |
| 289 | Ac-LDSQVIVTGNLDISTELGNVNNSISNALDKLEESN-NH2 | 286 |
| 290 | Ac-ILDSQVIVTGNLDISTELGNVNNSISNALDKLEES-NH2 | 287 |
| 291 | Ac-SILDSQVIVTGNLDISTELGNVNNSISNALDKLEE-NH2 | 288 |
| 292 | Ac-ISILDSQVIVTGNLDISTELGNVNNSISNALDKLE-NH2 | 289 |
| 293 | Ac-NISILDSQVIVTGNLDISTELGNVNNSISNALDKL-NH2 | 290 |
| 294 | Ac-KNISILDSQVIVTGNLDISTELGNVNNSISNALDK-NH2 | 291 |
| 295 | Ac-QKNISILDSQVIVTGNLDISTELGNVNNSISNALD-NH2 | 292 |
| 296 | Ac-YQKNISILDSQVIVTGNLDISTELGNVNNSISNAL-NH2 | 293 |
| 297 | Ac-TYQKNISILDSQVIVTGNLDISTELGNNNNSISNA-NH2 | 294 |
| 298 | Ac-ATYQKNISILDSQVIVTGNLDISTELGNVNNSISN-NH2 | 295 |
| 299 | Ac-DATYQKNISILDSQVIVTGNLDISTELGNVNNSIS-NH2 | 296 |
| 300 | Ac-FDATYQKNISILDSQVIVTGNLDISTELGNVNNSI-NH2 | 297 |
| 301 | Ac-EFDATYQKNISILDSQVIVTGNLDISTELGNVNNS-NH2 | 298 |
| 302 | Ac-GEFDATYQKNISILDSQVIVTGNLDISTELGNVNN-NH2 | 299 |
| 303 | Ac-SGEFDATYQKNISILDSQVIVTGNLDISTELGNVN-NH2 | 300 |
| 304 | Ac-LSGEFDATYQKNISILDSQVIVTGNLDISTELGNV-NH2 | 301 |
| 305 | Ac-RLSGEFDATYQKNISILDSQVIVTGNLDISTELGN-NH2 | 302 |
| 306 | Ac-LRLSGEFDATYQKNISILDSQVIVTGNLDISTELG-NH2 | 303 |
| 307 | Ac-TLRLSGEFDATYQKNISILDSQVIVTGNLDISTEL-NH2 | 304 |
| 308 | Ac-ITLRLSGEFDATYQKNISILDSQVIVTGNLDISTE-NH2 | 305 |
| 309 | Ac-GITLRLSGEFDATYQKNISILDSQVIVTGNLDIST-NH2 | 306 |
| 310 | Ac-TATIEAVHEVTDGLSQLAVAVGKMQQFVNDQFNNT-NH2 | 307 |
| 311 | Ac-ITATIEAVHEVTDGLSQLAVAVGKMQQFVNDQFNN-NH2 | 308 |
| 312 | Ac-SITATIEAVHEVTDGLSQLAVAVGKMQQFVNDQFN-NH2 | 309 |
| 313 | Ac-ESITATIEAVHEVTDGLSQLAVAVGKMQQFVNDQF-NH2 | — |
| 314 | Ac-KESITATIEAVHEVTDGLSQLAVAVGKMQQFVNDQ-NH2 | 310 |
| 315 | Ac-LKESITATIEAVHEVTDGLSQLAVAVGKMQQFVND-NH2 | 311 |
| 316 | Ac-RLKESITATIEAVHEVTDGLSQLAVAVGKMQQFVN-NH2 | 312 |
| 317 | Ac-LRLKESITATIEAVHEVTDGLSQLAVAVGKMQQFV-NH2 | 313 |
| 318 | Ac-ILRLKESITATIEAVHEVTDGLSQLAVAVGKMQQF-NH2 | 314 |
| 319 | Ac-NILRLKESITATIEAVHEVTDGLSQLAVAVGKMQQ-NH2 | 315 |
| 320 | Ac-ANILRLKESITATIEAVHEVTDGLSQLAVAVGKMQ-NH2 | 316 |
| 321 | Ac-AAMLRLKESITATIEAVHEVTDGLSQLAVAVGKM-NH2 | 317 |
| 322 | Ac-HKCDDECMNSVKNGTYDYPKYEEESKLNRNEIKGV-NH2 | 318 |
| 323 | Ac-KCDDECMNSVKNGTYDYPKYEEESKLNRNEIKGVK-NH2 | 319 |
| 324 | Ac-CDDECMNSVKNGTYDYPKYEEESKLNRNEIKGVKL-NH2 | 320 |
| 325 | Ac-DDECMNSVKNGTYDYPKYEEESKLNRNEIKGVKLS-NH2 | 321 |
| 326 | Ac-DECMNSVKNGTYDYPKYEEESKLNRNEIKGVKLSS-NH2 | 322 |
| 327 | Ac-ECMNSVKNGTYDYPKYEEESKLNRNEIKGVKLSSM-NH2 | 323 |
| 328 | Ac-CMNSVKNGTYDYPKYEEESKLNRNEIKGVKLSSMG-NH2 | 324 |
| 329 | Ac-MNSVKNGTYDYPKYEEESKLNRNEIKGVKLSSMGV-NH2 | 325 |
| 330 | Ac-NSVKNGTYDYPKYEEESKLNRNEIKGVKLSSMGVY-NH2 | 326 |
| 331 | Ac-SVKNGTYDYPKYEEESKLNRNEIKGVKLSSMGVYQ-NH2 | 327 |
| 332 | Ac-VKNGTYDYPKYEEESKLNRNEIKGVKLSSMGVYQI-NH2 | 328 |
| 333 | Ac-KNGTYDYPKYEEESKLNRNEIKGVKLSSMGVYQIL-NH2 | 329 |
| 334 | Ac-AFIRKSDELLHNV-NH2 | 330 |
| 335 | Ac-VVLAGAALGVATAAQITAGIALHQSMLNSQAIDNL-NH2 | 331 |
| 336 | Ac-VLAGAALGVATAAQITAGIALHQSMLNSQAIDNLR-NH2 | 332 |
| 337 | Ac-LAGAALGVATAAQITAGIALHQSMLNSQAIDNLRA-NH2 | 333 |
| 338 | Ac-AGAALGVATAAQITAGIALHQSMLNSQAIDNLRAS-NH2 | 334 |
| 339 | Ac-GAALGVATAAQITAGIALHQSMLNSQAIDNLRASL-NH2 | 335 |
| 340 | Ac-AALGVATAAQITAGIALHQSMLNSQAIDNLRASLE-NH2 | 336 |
| 341 | Ac-ALGVATAAQITAGIALHQSMLNSQAIDNLRASLET-NH2 | 337 |
| 342 | Ac-LGVATAAQITAGIALHQSMLNSQAIDNLRASLETT-NH2 | 338 |
| 343 | Ac-GVATAAQITAGIALHQSMLNSQAIDNLRASLETTN-NH2 | 339 |
| 344 | Ac-VATAAQITAGIALHQSMLNSQAIDNLRASLETTNQ-NH2 | 340 |
| 345 | Ac-ATAAQITAGIALHQSMLNSQAIDNLRASLETTNQA-NH2 | 341 |
| 346 | Ac-TAAQITAGIALHQSMLNSQAIDNLRASLETTNQAI-NH2 | 342 |
| 347 | Ac-AAQITAGIALHQSMLNSQAIDNLRASLETTNQAIE-NH2 | 343 |
| 348 | Ac-AQITAGIALHQSMLNSQAIDNLRASLETTNQAIEA-NH2 | 344 |
| 349 | Ac-QITAGIALHQSMLNSQAIDNLRASLETTNQAIEAI-NH2 | 345 |
| 350 | Ac-ITAGIALHQSMLNSQAIDNLRASLETTNQAIEAIR-NH2 | 346 |
| 351 | Ac-TAGIALHQSMLNSQAIDNLRASLETTNQAIEAIRQ-NH2 | 347 |
| 352 | Ac-AGIALHQSMLNSQAIDNLRASLETTNQAIEAIRQA-NH2 | 348 |
| 353 | Ac-GIALHQSMLNSQAIDNLRASLETTNQAIEAIRQAG-NH2 | 349 |
| 354 | Ac-IALHQSMLNSQAIDNLRASLETTNQAIEAIRQAGQ-NH2 | 350 |
| 355 | Ac-ALHQSMLNSQAIDNLRASLETTNQAIEAIRQAGQE-NH2 | 351 |
| 356 | Ac-LHQSMLNSQAIDNLRASLETTNQAIEAIRQAGQEM-NH2 | 352 |
| 357 | Ac-HQSMLNSQAIDNLRASLETTNQAIEAIRQAGQEMI-NH2 | 353 |
| 358 | Ac-QSMLNSQAIDNLRASLETTNQAIEAIRQAGQEMIL-NH2 | 354 |
| 359 | Ac-SMLNSQAIDNLRASLETTNQAIEAIRQAGQEMILA-NH2 | 355 |
| 360 | Ac-MLNSQAIDNLRASLETTNQAIEAIRQAGQEMILAV-NH2 | 356 |

TABLE V-continued

| T No. | Sequence | Seq. ID No. |
|---|---|---|
| 361 | Ac-LNSQAIDNLRASLETTNQAIEAIRQAGQEMILAVQ-NH2 | 357 |
| 362 | Ac-NSQAIDNLRASLETTNQAIEAIRQAGQEMILAVQG-NH2 | 358 |
| 363 | Ac-SQAIDNLRASLETTNQAIEAIRQAGQEMILAVQGV-NH2 | 359 |
| 364 | Ac-QAIDNLRASLETTNQAIEAIRQAGQEMILAVQGVQ-NH2 | 360 |
| 365 | Ac-AIDNLRASLETTNQAIEAIRQAGQEMILAVQGVQD-NH2 | 361 |
| 366 | Ac-IDNLRASLETTNQAIEAIRQAGQEMILAVQGVQDY-NH2 | 362 |
| 367 | Ac-DNLRASLETTNQAIEAIRQAGQEMILAVQGVQDYI-NH2 | 363 |
| 368 | Ac-NLRASLETTNQAIEAIRQAGQEMILAVQGVQDYIN-NH2 | 364 |
| 369 | Ac-LRASLETINQAIEAIRQAGQEMILAVQGVQDYINN-NH2 | 365 |
| 370 | Ac-RASLETTNQAIEAIRQAGQEMILAVQGVQDYINNE-NH2 | 366 |
| 371 | Ac-YTSVITIELSNIKENKUNGTDAVKLIKQELDKYK-NH2 | 1907 |
| 372 | Ac-TSVITIELSNIKENKUNGTDAVKLIKQELDKYKN-NH2 | 1908 |
| 373 | Ac-SVITIELSNIKENKUNGTDAVKLIKQELDKYKNA-NH2 | 1909 |
| 374 | Ac-SNIKENKUNGTDAKVKLIKQELDKYKNAVTELQLL-NH2 | 1910 |
| 375 | Ac-KENKUNGTDAKVKLIKQELDKYKNAVTELQLLMQS-NH2 | 1911 |
| 376 | Ac-CLELDKWASLWNWFC-NH2 | 372 |
| 377 | Ac-CLELDKWASLANWFC-NH2 | 373 |
| 378 | Ac-CLELDKWASLFNFFC-NH2 | 374 |
| 379 | Ac-YTSLIHSLIEESQNQQEKNEQELLELDKWASLFNFF-NH2 | 375 |
| 381 | Ac-RMKQLEDKVEELLSKNYHLENELELDKWASLWNWF-NH2 | 376 |
| 382 | Ac-KVEELLSKNYHLENELELDKWASLWNWF-NH2 | 377 |
| 383 | Ac-RMKQLEDKVEELLSKLEWIRRSNQKLDSI-NH2 | 378 |
| 384 | Ac-RMKQLEDKVEELLSKLAFIRKSDELLHNV-NH2 | 379 |
| 385 | Ac-ELEALRGELRALRGELELDKWASLWNWF-NH2 | 380 |
| 386 | Ac-LDPIDISIELNKAKSDLEESKEWIRRSNQKLDSI-NH2 | 381 |
| 387 | Ac-CNEQLSDSFPVEFFQV-NH2 | 382 |
| 388 | Ac-MAEDDPYLGRPEQMFHLDPSL-NH2 | 383 |
| 389 | Ac-EDFSSLADMDFSALLSQISS-NH2 | 384 |
| 390 | Ac-TWQEWERKVDFLEENITALLEEAQIQQEKNMYELQ-NH2 | 385 |
| 391 | Ac-WQEWERKVDFLEENITALLEEAQIQQEKNMYELQK-NH2 | 386 |
| 392 | Ac-QEWERKVDFLEENITALLEEAQIQQEKNMYELQKL-NH2 | 387 |
| 393 | Ac-EWERKVDFLEENITALLEEAQIQQEKNMYELQKLN-NH2 | 388 |
| 394 | Ac-WERKVDFLEENITALLEEAQIQQEKNMYELQKLNS-NH2 | 389 |
| 395 | Ac-ERKVDFLEENITALLEEAQIQQEKNMYELQKLNSW-NH2 | 390 |
| 396 | Ac-RKVDFLEENITALLEEAQIQQEKNMYELQKLNSWD-NH2 | 391 |
| 397 | Ac-KVDFLEENITALLEEAQIQQEKNMYELQKLNSWDV-NH2 | 392 |
| 398 | Ac-VDFLEENITALLEEAQIQQEKNMYELQKLNSWDVF-NH2 | 393 |
| 399 | Ac-DFLEENITALLEEAQIQQEKNMYELQKLNSWDVFG-NH2 | 394 |
| 400 | Ac-FLEENITALLEEAQIQQEKNMYELQKLNSWDVFGN-NH2 | 395 |
| 401 | Ac-LEENITALLEEAQIQQEKNMYELQKLNSWDVFGNW-NH2 | 396 |
| 402 | Ac-LEENITALLEEAQIQQEKNMYELQKLNSWDVFGNWF-NH2 | 397 |
| 403 | Ac-NEQSEEKENELYWAKEQLLDLLFNIFNQTVGAWIMQ-NH2 | 398 |
| 405 | Ac-QQQLLDVVKRQQELLRLTVWGTKNLQTRVTAIEKYLKD-NH2 | 400 |
| 406 | Ac-QQLLDVVKRQQELLRLTVWGTKNLQTRVTAIEKYLKDQ-NH2 | 401 |
| 407 | Ac-QQLLDVVKRQQELLRLTVWGPKNLQTRVTAIEKYLKDQ-NH2 | 402 |
| 408 | Ac-DERKQDKVLVVQQTGTLQLTLIQLEKTAKLQWVRLNRY-NH2 | 403 |
| 409 | Ac-QQQLLDVVKRQQELLRLTVWGTKNLQTRVTAIEKY-NH2 | 404 |
| 410 | Ac-QQLLDVVKRQQELLRLTVWGTKNLQTRVTAIEKYL-NH2 | 405 |
| 411 | Ac-QLLDVVKRQQELLRLTVWGTKNLQTRVTAIEKYLK-NH2 | 406 |
| 412 | Ac-LLDVVKRQQELLRLTVWGTKNLQTRVTAIEKYLKD-NH2 | 407 |
| 413 | Ac-LDVVKRQQELLRLTVWGTKNLQTRVTAIEKYLKDQ-NH2 | 408 |
| 414 | Ac-DVVKRQQELLRLTVWGTKNLQTRVTAIEKYLKDQA-NH2 | 409 |
| 415 | Ac-VVKRQQELLRLTVWGTKNLQTRVTAIEKYLKDQAQ-NH2 | 410 |
| 416 | Ac-VKRQQELLRLTVWGTKNLQTRVTAIEKYLKDQAQL-NH2 | 411 |
| 417 | Ac-KRQQELLRLTVWGTKNLQTRVTAIEKYLKDQAQLN-NH2 | 412 |
| 418 | Ac-RQQELLRLTVWGTKNLQTRVTAIEKYLKDQAQLNA-NH2 | 413 |
| 419 | Ac-QQELLRLTVWGTKNLQTRVTAIEKYLKDQAQLNAW-NH2 | 414 |
| 420 | Ac-QELLRLTVWGTKNLQTRVTAIEKYLKDQAQLNAWG-NH2 | 415 |
| 421 | Ac-ELLRLTVWGTKNLQTRVTAIEKYLKDQAQLNAWGC-NH2 | 416 |
| 422 | Ac-NNLLRAIEAQQHLLQLTVWGPKQLQARILAVERYLKDQ-NH2 | 417 |
| 423 | Ac-SELEIKRYKNRVASRKCRAKFKQLLQHYREVAAAK-NH2 | 418 |
| 424 | Ac-ELEIKRYKNRVASRKCRAKFKQLLQHYREVAAAKS-NH2 | 419 |
| 425 | Ac-LEIKRYKNRVASRKCRAKFKQLLQHYREVAAAKSS-NH2 | 420 |
| 426 | Ac-EIKRYKNRVASRKCRAKFKQLLQHYREVAAAKSSE-NH2 | 421 |
| 427 | Ac-IKRYKNRVASRKCRAKFKQLLQHYREVAAAKSSEN-NH2 | 422 |
| 428 | Ac-KRYKNRVASRKCRAKFKQLLQHYREVAAAKSSEND-NH2 | 423 |
| 429 | Ac-RYNNRVASRKCRAKFKQLLQHYREVAAAKSSENDW-NH2 | 424 |
| 430 | Ac-YKNRVASRKCRAKFKQLLQHYREVAAAKSSENDRL-NH2 | 425 |
| 431 | Ac-KNRVASRKCRAKFKQLLQHYREVAAAKSSENDRLR-NH2 | 426 |
| 432 | Ac-NRVASRKCRAKFKQLLQHYREVAAAKSSENDRLRL-NH2 | 427 |
| 433 | Ac-RVASRKCRAKFKQLLQHYREVAAAKSSENDRLRLL-NH2 | 428 |
| 434 | Ac-VASRKCRAKFKQLLQHYREVAAAKSSENDRLRLLL-NH2 | 429 |
| 435 | Ac-ASRKCRAKFKQLLQHYREVAAAKSSBNDRLRLLLK-NH2 | 430 |
| 436 | Ac-SRKCRAKFKQLLQHYREVAAAKSSENDRLRLLLKQ-NH2 | 431 |
| 437 | Ac-RKCRAKFKQLLQHYREVAAAKSSENDRLRLLLKQM-NH2 | 432 |
| 438 | Ac-KCRAKFKQLLQHYREVAAAKSSENDRLRLLLKQMC-NH2 | 433 |

TABLE V-continued

| T No. | Sequence | Seq. ID No. |
|---|---|---|
| 439 | Ac-CRAKFKQLLQHYREVAAAKSSENDRLRLLLKQMCP-NH2 | 434 |
| 440 | Ac-RAKFKQLLQHYREVAAAKSSENDRLRLLLKQMCPS-NH2 | 435 |
| 441 | Ac-AKFKQLLQHYREVAAAKSSENDRLRLLLKQMCPSL-NH2 | 436 |
| 442 | Ac-KFKQLLQHYREVAAAKSSENDRLRLLLKQMCPSLD-NH2 | 437 |
| 443 | Ac-FKQLLQHYREVAAAKSSENDRLRLLLKQMCPSLDV-NH2 | 438 |
| 444 | Ac-KQLLQHYREVAAAKSSENDRLRLLLKQMCPSLDVD-NH2 | 439 |
| 445 | Ac-QLLQHYREVAAAKSSENDRLRLLLKQMCPSLDVDS-NH2 | 440 |
| 446 | Ac-LLQHYREVAAAKSSENDRLRLLLKQMCPSLDVDSI-NH2 | 441 |
| 447 | Ac-LQHYREVAAAKSSENDRLRLLLKQMCPSLDVDSII-NH2 | 442 |
| 448 | Ac-QHYREVAAAKSSENDRLRLLLKQMCPSLDVDSIIP-NH2 | 443 |
| 449 | Ac-HYREVAAAKSSENDRLRLLLKQMCPSLDVDSIIPR-NH2 | 444 |
| 450 | Ac-YREVAAAKSSENDRLRLLLKQMCPSLDVDSIIPRT-NH2 | 445 |
| 451 | Ac-REVAAAKSSENDRLRLLLKQMCPSLDVDSIIPRTP-NH2 | 446 |
| 452 | Ac-EVAAAKSSENDRLRLLLKQMCPSLDVDSIIPRTPD-NH2 | 447 |
| 453 | Ac-VAAAKSSENDRLRLLLKQMCPSLDVDSIIPRTPDV-NH2 | 448 |
| 454 | Ac-AAAKSSENDRLRLLLKQMCPSLDVDSIIPRTPDVL-NH2 | 449 |
| 455 | Ac-AAKSSENDRLRLLLKQMCPSLDVDSIIPRTPDVLH-NH2 | 450 |
| 456 | Ac-AKSSENDRLRLLLKQMCPSLDVDSIIPRTPDVLHE-NH2 | 451 |
| 457 | Ac-KSSENDRLRLLLKQMCPSLDVDSIIPRTPDVLHED-NH2 | 452 |
| 458 | Ac-SSENDRLRLLLKQMCPSLDVDSIIPRTPDVLHEDL-NH2 | 453 |
| 459 | Ac-SENDRLRLLLKQMCPSLDVDSIIPRTPDVLHEDLL-NH2 | 454 |
| 460 | Ac-ENDRLRLLLKQMCPSLDVDSIIPRTPDVLHEDLLN-NH2 | 455 |
| 461 | Ac-NDRLRLLLKQMCPSLDVDSIIPRTPDVLHEDLLNF-NH2 | 456 |
| 534 | Ac-PGYRWMCLRRFIIFLFILLLCLIFLLVLLDYQGML-NH2 | 458 |
| 535 | Ac-GYRWMCLRRFIIFLFILLLCLIFLLVLLDYQGMLP-NH2 | 459 |
| 536 | Ac-YRWMCLRRFIIFLFILLLCLIFLLVLLDYQGMLPV-NH2 | 460 |
| 537 | Ac-RWMCLRRFIIFLFILLLCLIFLLVLLDYQGMLPVC-NH2 | 461 |
| 538 | Ac-WMCLRRFIIFLFILLLCLIFLLVLLDYQGMLPVCP-NH2 | 462 |
| 539 | Ac-MCLRRFIIFLFILLLCLIFLLVLLDYQGMLPVCPL-NH2 | 463 |
| 540 | Ac-CLRRFIIFLFILLLCLIFLLVLLDYQGMLPVCPLI-NH2 | 464 |
| 541 | Ac-LRRFIIFLFILLLCLIFLLVLLDYQGMLPVCPLIP-NH2 | 465 |
| 542 | Ac-RRFIIFLFILLLCLIFLLVLLDYQGMLPVCPLIPG-NH2 | 466 |
| 543 | Ac-RFIIFLFILLLCLWLLVLLDYQGMLPVCPLIPGS-NH2 | 467 |
| 544 | Ac-FIIFLFILLLCLIFLLVLLDYQGMLPVCPLIPGSS-NH2 | 468 |
| 545 | Ac-IIFLFILLLCLWLLVLLDYQGMLPVCPLIPGSST-NH2 | 469 |
| 546 | Ac-IFLFILLLCLIFLLVLLDYQGMLPVCPLIPGSSTF-NH2 | 470 |
| 547 | Ac-FLFILLLCLIFLLVLLDYQGMLPVCPLIPGSSTFS-NH2 | 471 |
| 548 | Ac-LFILLLCLIFLLVLLDYQGMLPVCPLIPGSSTFST-NH2 | 472 |
| 549 | Ac-FILLLCLIFLLVLLDYQGMLPVCPLFPGSSTFSTG-NH2 | 473 |
| 550 | Ac-ILLLCLIFLLVLLDYQGMLPVCPLIPGSSTTSTGP-NH2 | 474 |
| 551 | Ac-LLLCLIFLLVLLDYQGMLPVCPLIPGSSTFSTGPC-NH2 | 475 |
| 552 | Ac-LLCLIFLLVLLDYQGMLPVCPLIPGSSTFSTGPCR-NH2 | 476 |
| 553 | Ac-LCLIFLLVLLDYQGMLPVCPLIPGSSTFSTGPCRT-NH2 | 477 |
| 554 | Ac-CLIFLLVLLDYQGMLPVCPLIPGSSTFSTGPCRTC-NH2 | 478 |
| 555 | Ac-LIFLLVLLDYQGMLPVCPLIPGSSTFSTGPCRTCM-NH2 | 479 |
| 556 | Ac-IFLLVLLDYQGMLPVCPLIPGSSTFSTGPCRTCMT-NH2 | 480 |
| 557 | Ac-FLLVLLDYQGMLPVCPLIPGSSTFSTGPCRTCMTF-NH2 | 481 |
| 558 | Ac-PPLVLQAGFFLLTRILTIPQSLDSWWTSLNFLGGT-NH2 | 1912 |
| 559 | Ac-LLVLQAGFFLLTRILTIPQSLDSWWTSLNFLGGTF-NH2 | 483 |
| 560 | Ac-LVLQAGFFLLTRILTIPQSLDSWWTSLNFLGGFFV-NH2 | 484 |
| 561 | Ac-VLQAGFFLLTRILTIPQSLDSWWTSLNFLGGTFVC-NH2 | 485 |
| 562 | Ac-LQAGFFLLTRILTIPQSLDSWWTSLNFLGGTFVCL-NH2 | 486 |
| 563 | Ac-QAGFFLLTRILTIPQSLDSWWTSLNFLGGTFVCLG-NH2 | 487 |
| 564 | Ac-AGFFLLTRILTIPQSLDSWWTSLNFLGGTFVCLGQ-NH2 | 488 |
| 565 | Ac-GFFLLTRILTIPQSLDSWWTSLNFLGGTFVCLGQN-NH2 | 489 |
| 566 | Ac-FFLLTRILTIPQSLDSWWTSLNFLGGTFVCLGQNS-NH2 | 490 |
| 567 | Ac-FLLTRILTIPQSLDSWWTSLNFLGGTFVCLGQNSQ-NH2 | 491 |
| 568 | Ac-LLTRILTIPQSLDSWWTSLNFLGGTFVCLGQNSQS-NH2 | 492 |
| 569 | Ac-LTRILTIPQSLDSWWTSLNFLGGTFVCLGQNSQSP-NH2 | 493 |
| 570 | Ac-FWNWLSAWKDLELKSLLEEVKDELQKMR-NH2 | 494 |
| 571 | Ac-NNLLRAIEAQQHLLQLTVW-NH2 | 495 |
| 572 | Ac-CGGNNLLRAIEAQQHLLQLTVWGIKQLQARILAVERYLKDQ-NH2 | 496 |
| 573 | Ac-YTSLIHSLIEESQNQQEKNEQELLELDKWASLWNWF-NH2 | 497 |
| 574 | C13H27CO-YTSLIHSLIEESQNQQEKNEQELLELDKWASLWNWF-NH2 | 498 |
| 575 | Ac-AVSKGYLSALRTGWYTSVITIELSNIKENKUNGTDA-NH2 | 1913 |
| 576 | Ac-SISNIETVIEFQQKNNRLLEITREFSVNAGVTFPVS-NH2 | 500 |
| 577 | Ac-DQQIKQYKRLLDRLIIPLYDGLRQKDVIVSNQESN-NH2 | 501 |
| 578 | Ac-YSELTNIFGDNIGSLQEKGIKLQGIASLYRTNITEI-NH2 | 502 |
| 579 | Ac-TSITLQVRLPLLTRLLNTQIYRVDSISYNIQNREWY-NH2 | 503 |
| 580 | Ac-VEIAEYRRLLRTVLEPIRDALNAMTQNIRPVQSVA-NH2 | 504 |
| 581 | Ac-SYFIVLSIAYPTLSEIKGVIVHRLEGVSYNIGSQEW-NH2 | 505 |
| 582 | Ac-LKEAIRDTNKAVQSVQSSIGNLIVAIKS-NH2 | 506 |
| 583 | NNLLRAIEAQQHLLQLTVWGIKQLQARILAVERYLKDQ-NH2 | 507 |
| 583 | NNLLRAIEAQQHLLQLTVWGIKQLQARILAVERYLKDQ-NH2 | 507 |
| 584 | QKQEPWKELYPLTSL | 508 |
| 585 | YPKFVKQNTLKLAT | 509 |

TABLE V-continued

| T No. | Sequence | Seq. ID No. |
|---|---|---|
| 586 | QYIKANQKFIGITE | 510 |
| 587 | NGQIGNDPNRDILY | 511 |
| 588 | AC-RPDVY-OH | 512 |
| 589 | CLELDKWASLWNWFC-(cyclic) | 513 |
| 590 | CLELDKWASLANWFC-(cyclic) | 514 |
| 591 | CLELDKWASLANFFC-(cyclic) | 515 |
| 594 | Ac-NNLLRAIEAQQQHLLQLTVWGIKQLQARILAVERYLKDQ-NH2 | 516 |
| 595 | Ac-CGGYTSLIHSLIEESQNQQEKNEQELLELDKWASLWNNWF-NH2 | 517 |
| 596 | Ac-PLLVLQAGFFLLTkILTIPQSLDSWWTSLNFLGGT-NH2 | 518 |
| 597 | Ac-LLVLQAGFFLLTRILTIPQSLDSWWTSLNFLGGTT-NH2 | 519 |
| 598 | Ac-LVLQAGFFLLTRILTIPQSLDSWWTSLNFLGGTTV-NH2 | 520 |
| 599 | Ac-VLQAGFFLLTRILTIPQSLDSWWTSLNFLGGTTVC-NH2 | 521 |
| 600 | Ac-LQAGFFLLTRILTIPQSLDSWWTSLNFLGGTTVCL-NH2 | 522 |
| 601 | Ac-QAGFFLLTRILTIPQSLDSWWTSLNFLGGTTVCLG-NH2 | 523 |
| 602 | Ac-AGFFLLTRILTIPQSLDSWWTSLNFLGGTTVCLGQ-NH2 | 524 |
| 603 | Ac-GFFLLTRILTIPQSLDSWWTSLNFLGGTFVCLGQN-NH2 | 525 |
| 604 | Ac-FFLLTRILTIPQSLDSWWTSLNFLGGITVCLGQNS-NH2 | 526 |
| 605 | Ac-FLLTRILTIPQSLDSWWTSLNFLGGTFVCLGQNSQ-NH2 | 527 |
| 606 | Ac-LLTRILTIPQSLDSWWTSLNFLGGTTVCLGQNSQS-NH2 | 528 |
| 607 | Ac-LTRILTIPQSLDSWWTSLNFLGGTTVCLGQNSQSP-NH2 | 529 |
| 608 | Ac-LELDKWASLWNWA-NH2 | 530 |
| 609 | Ac-LELDKWASAWNWF-NH2 | 531 |
| 610 | Ac-LELDKAASLWNWF-NH2 | 532 |
| 611 | Ac-LKLDKWASLWNWF-NH2 | 533 |
| 612 | Ac-LELKKWASLWNWF-NH2 | 534 |
| 613 | Ac-DELLHNVAGKST-NH2 | 535 |
| 614 | Ac-KSDELLHNVAGKST-NH2 | 536 |
| 615 | Ac-IRKSDELLHNVAGKST-NH2 | 537 |
| 616 | Ac-AFIRKSDELLHNVAGKST-NH2 | 538 |
| 617 | Ac-FDASISQVNEKINQSLAFI-NH2 | 539 |
| 618 | Ac-YAADKESTQKAFDGITNKVNSVIEKMNTQFEAVGKE-NH2 | 540 |
| 619 | Ac-SVIEKMNTQFEAVGKEFGNLERRLENLNKRMEDGFL-NH2 | 541 |
| 620 | Ac-VWTYNAELLVLMENERTLDFHDSNVKNLYDKVRMQL-NH2 | 542 |
| 621 | Ac-EWDREINTNYTSLIHSLIEESQNQQEKNEQEGGC-NH2 | 543 |
| 622 | Ac-TNNYTSLIHSLIEESQNQQEKNEQELLELDKWASL-NH2 | 544 |
| 623 | Ac-INNYTSLIHSLIEESQNQQEKNEQELLE-NH2 | 545 |
| 624 | Ac-WMEWDRELNNYTSLIHSLIEESQNQQEKNEQELLE-NH2 | 546 |
| 625 | Ac-MTWMEWDREINNYTSLIHSLIEESQNQQEKNEQELLELDKWASLWNWF-NH2 | 547 |
| 626 | Ac-IDISIELNKAKSDLEESKEWIKKSNQKLDSIGNWH-NH2 | 548 |
| 627 | Ac-NQQEKNEQELLELDKWASLWNWFNITNWLWYIKIFI-NH2 | 549 |
| 627 | Ac-NQQEKNEQELLELDKWASLWNWFNITNWLWYIKIFI-NH2 | 549 |
| 628 | Ac-QNQQEKNEQELLELDKWASLWNWFNITNWLWYIKIF-NH2 | 550 |
| 629 | Ac-SQNQQEKNEQELLELDKWASLWNWFNITNWLWYIKI-NH2 | 551 |
| 630 | Ac-ESQNQQEKNEQELLELDKWASLWNWFNITNWLWYIK-NH2 | 552 |
| 631 | Ac-EESQNQQEKNEQELLELDKWASLWNWFNITNWLWYI-NH2 | 553 |
| 632 | Ac-IEESQNQQEKNEQELLELDKWASLWNWFNITNWLWY-NH2 | 554 |
| 633 | Ac-LIEESQNQQEKNEQELLELDKWASLWNWFNITNWLW-NH2 | 555 |
| 634 | Ac-SLIEESQNQQEKNEQELLELDKWASLWNWFNITNWL-NH2 | 556 |
| 635 | Ac-HSLIEESQNQQEKNEQELLELDKWASLWNWFNITNW-NH2 | 557 |
| 636 | Ac-IHSLIEESQNQQEKNEQELLELDKWASLWNWFNITN-NH2 | 558 |
| 637 | Ac-LIHSLIEESQNQQEKNEQELLELDKWASLWNWFNIT-NH2 | 559 |
| 638 | Ac-SLIHSLIEESQNQQEKNEQELLELDKWASLWNWFNI-NH2 | 560 |
| 639 | Ac-TSLIHSLIEESQNQQEKNEQELLELDKWASLWNWFN-NH2 | 561 |
| 640 | Ac-NYTSLIHSLIEESQNQQEKNEQELLELDKWASLWNW-NH2 | 562 |
| 641 | Ac-NNYTSLIHSLIEESQNQQEKNEQELLELDKWASLWN-NH2 | 563 |
| 642 | Ac-INNYTSLIHSLIEESQNQQEKNEQELLELDKWASLW-NH2 | 564 |
| 643 | Ac-EINNYTSLIHSLIEESQNQQEKNEQELLELDKWASL-NH2 | 565 |
| 644 | Ac-REINNYTSLIHSLIEESQNQQEKNEQELLELDKWAS-NH2 | 566 |
| 645 | Ac-DREINNYTSLIHSLIEESQNQQEKNEQELLELDKWA-NH2 | 567 |
| 646 | Ac-WDREINNYTSLIHSLIEESQNQQEKNEQELLELDKW-NH2 | 568 |
| 647 | Ac-EWDREINNYTSLIHSLIEESQNQQEKNEQELLELDK-NH2 | 569 |
| 648 | Ac-MEWDREINNYTSLIHSLIEESQNQQEKNEQELLELD-NH | 570 |
| 649 | Ac-WMEWDREINNYTSLIHSLIEESQNQQEKNEQELLEL-NH2 | 572 |
| 650 | Ac-TWMEWDREINNYTSLIHSLIEESQNQQEKNEQELLE-NH2 | 573 |
| 651 | Ac-MTWMEWDREINNYTSLIHSLIEESQNQQEKNEQELL-NH2 | 574 |
| 652 | Ac-NMTWMEWDREINNYTSLIHSLIEESQNQQEKNEQEL-NH2 | 575 |
| 653 | Ac-NNMTWMEWDREINNYTSLIHSLIEESQNQQEKNEQE-NH2 | 576 |
| 654 | Ac-WNNMTWMEWDREINNYTSLIHSLIEESQNQQEKNEQ-NH2 | 577 |
| 655 | Ac-IWNNMTWMEWDREINNYTSLIHSLIEESQNQQEKNE-NH2 | 578 |
| 656 | Ac-QIWNNMTWMEWDREINNYTSLIHSLIEESQNQQEKN-NH2 | 579 |
| 657 | Ac-EQIWNNMTWMEWDREINNYTSLIHSLIEESQNQQEK-NH2 | 580 |
| 658 | Ac-LEQIWNNMTWMEWDREINNYTSLIHSLIEESQNQQE-NH2 | 581 |
| 659 | Ac-SLEQIWNNMTWMEWDREINNYTSLIHSLIEESQNQQ-NH2 | 582 |
| 660 | Ac-KSLEQIWNNMTWMEWDREINNYTSLIHSLIEESQNQ-NH2 | 583 |
| 661 | Ac-NKSLEQIWNNMTWMEWDREINNYTSLIHSLIEESQN-NH2 | 584 |
| 662 | Ac-SLAFIRKSDELLHNVAGKST-NH2 | 585 |

TABLE V-continued

| T No. | Sequence | Seq. ID No. |
|---|---|---|
| 663 | Ac-FDASISQVNEKINQSLAFIRK-NH2 | 586 |
| 664 | Ac-YTSLIHSLIEESQQQQEKQEQELLELDKWASLWNWF-NH2 | 587 |
| 665 | Ac-FDASISQVNEKINQSLAFIRKSDELLHNVNAGK-NH2 | 588 |
| 666 | Ac-FDASISQVNEKINQSLAFIRKSDELLHNVNA-NH2 | 589 |
| 667 | Ac-FDASISQVNEKINQSLAFIRKSDELLHNV-NH2 | 590 |
| 668 | Ac-FDASISQVNEKINQSLAFIRKSDELLH-NH2 | 591 |
| 669 | Ac-FDASISQVNEKINQSLAFIRKSDEL-NH2 | 592 |
| 670 | Ac-FDASISQVNEKINQSLAFIRKSD-NH2 | 593 |
| 671 | Ac-ASISQVNEKINQSLAFIRKSDELLHNVNAGKST-NH2 | 594 |
| 672 | Ac-ISQVNEKINQSLAFIRKSDELLHNVNAGKST-NH2 | 595 |
| 673 | Ac-QVNEKINQSLAFIRKSDELLHNVNAGKST-NH2 | 596 |
| 674 | Ac-NEKINQSLAFIRKSDELLHNVNAGKST-NH2 | 597 |
| 675 | Ac-KINQSLAFIRKSDELLHNVNAGKST-NH2 | 598 |
| 676 | Ac-NQSLAFIRKSDELLHNVNAGKST-NH2 | 599 |
| 677 | Ac-FWNWLSAWKDLELYPGSLELDKWASLWNWF-NH2 | 600 |
| 678 | Ac-CGGNNLLRAIEAQQHLLQLTVWGIKQLQARILAVERYLKDQ-NH2 | 601 |
| 679 | Ac-CGGYTSLIHSLIEESQNQQEKNEQELLELDKWASLWNWF-NH2 | 602 |
| 680 | YTSLIHSLIEESQNQQEKNEQELLELDKWASLWNWF | 603 |
| 681 | NNLLRAIEAQQHLLQLTVWGIKQLQARILAVERYLKDQ | 604 |
| 682 | Ac-EKNMYELQKLNSWDVFTNWLDFTSWVRYIQYIQYGV-NH2 | 605 |
| 683 | Ac-QEKNMYELQKLNSWDVFTNWLDFTSWVRYIQYIQYG-NH2 | 606 |
| 684 | Ac-QQEKNMYELQKLNSWDVFTNWLDFTSWVRYIQYIQY-NH2 | 607 |
| 685 | Ac-IQQEKNMYELQKLNSWDVFTNWLDFTSWVRYIQYIQ-NH2 | 608 |
| 686 | Ac-QIQQEKNMYELQKLNSWDVFTNWLDFTSWVRYIQYI-NH2 | 609 |
| 687 | Ac-AQIQQEKNMYELQKLNSWDVFTNWLDFTSWVRYIQY-NH2 | 610 |
| 688 | Ac-QAQIQQEKNMYELQKLNSWDVFTNWLDFTSWVRYIQ-NH2 | 611 |
| 689 | Ac-EQAQIQQEKNMYELQKLNSWDVFTNWLDFTSWVRYI-NH2 | 612 |
| 690 | Ac-LEQAQIQQEKNMYELQKLNSWDVTTNWLDFTSWVRY-NH2 | 613 |
| 691 | Ac-SLEQAQIQQEKNMYELQKLNSWDVFTNWLDFTSWVR-NH2 | 614 |
| 692 | Ac-QSLEQAQIQQEKNMYELQKLNSWDVFTNWLDFTSWV-NH2 | 615 |
| 693 | Ac-SQSLEQAQIQQEKNMYELQKLNSWDVFTNWLDFTSW-NH2 | 616 |
| 694 | Ac-ISQSLEQAQIQQEKNMYELQKLNSWDVFTNWLDFTS-NH2 | 617 |
| 695 | Ac-NISQSLEQAQIQQEKNMYELQKLNSWDVFTNWLDFT-NH2 | 618 |
| 696 | Ac-ANISQSLEQAQIQQEKNMYELQKLNSWDVFTNWLDF-NH2 | 619 |
| 697 | Ac-EANISQSLEQAQIQQEKNMYELQKLNSWDVFTNWLD-NH2 | 620 |
| 699 | Ac-YLEANISQSLEQAQIQQEKNMYELQKLNSWDVFTNW-NH2 | 622 |
| 700 | Ac-YTSLIHSLIEESQNQQEKNEQEL-NH2 | 623 |
| 701 | Ac-YTSLIHSLIEESQNLQEKNEQELLELDKWASLWNWF-NH2 | 624 |
| 702 | Ac-YTSLIHSLIEESQNQQEKLEQELLELDKWASLWNWF-NH2 | 625 |
| 703 | Ac-YTSLIHSLIEESQNQQEKNEQELLEFDKWASLWNWF-NH2 | 626 |
| 704 | Ac-YTSLIHSLIEESQNQQEKNEQELLELDKPASLWNWF-NH2 | 627 |
| 705 | Ac-YTSLIHSLIEESQNQQEKNEQELLELDKWASPWNWF-NH2 | 628 |
| 706 | Ac-YTSLIHSLIEESQNQQEKNEQELLELDKWASLWNSF-NH2 | 629 |
| 707 | Biotin NH(CH2)4CO-YTSLIHSLIEESQNQQEKNEQELLELDKWASLWNWF-NH2 | 705 |
| 708 | Biotin NH(CH2)6CO-YTSLIHSLIEESQNQQEKNEQELLELDKWASLWNWF-NH2 | 630 |
| 709 | FMOC-YTSLIHSLIEESQNQQEKNEQELLELDKWASLWNWF | 497 |
| 710 | FMOC-NNLLRAIEAQQHLLQLTVWGIKQLQARILAVERYLKDQ | 16 |
| 711 | Ac-EWDREINNYTSLIHSLIEESQNQQEKNEQE-NH2 | 634 |
| 712 | Ac-LIEESQNQQEKNEQELLELDKWASLWNWF-NH2 | 635 |
| 713 | Ac-FWNWLSAWKDLELGGPGSGPGGLELDKWASLWNWF-NH2 | 636 |
| 714 | Ac-LIHSLIEESQNQQEKNEQELLELDKWASL-NH2 | 637 |
| 715 | Ac-TSLIHSLIEESQNQQEKNEQELLELDKWASLWNWF-NH2 | 638 |
| 716 | Ac-LIHSLIEESQNQQEKNEQELLELDKWASLWNWF-NH2 | 639 |
| 718 | FMOC-GGGGGYTSLIHSLIEESQNQQEKNEQELLELDKWASLWNWF-NH2 | 640 |
| 719 | Ac-HSLIEESQNQQEKNEQELLELDKWASLWWWF-NH2 | 641 |
| 720 | Ac-YTSLIYSLIEESQNQQEKNEQELLELDKWASLWNWF-NH2 | 642 |
| 721 | Ac-YTSLIHSLIEKSQNQQEKNEQELLELDKWASLWNWF-NH2 | 643 |
| 722 | Ac-YTSLIHSSIEESQNQQEKNEQELLELDKWASLWNWF-NH2 | 644 |
| 723 | Ac-LEANISQLLEQAQIQQEKNMYELQKLNSWDVFTNWL-NH2 | 645 |
| 724 | Ac-SLEECDSELEIKRYKNRVASRKCRAKFKQLLQHYR-NH2 | 646 |
| 725 | Ac-LEECDSELEIKRYNNRVASRKCRAKFKQLLQHYRE-NH2 | 647 |
| 726 | Ac-EECDSELEIKRYKNRVASRKCRAKFKQLLQHYREV-NH2 | 648 |
| 727 | Ac-ECDSELEIKRYKNRVASRKCRAKFKQLLQHYREVA-NH2 | 649 |
| 728 | Ac-CDSELEIKRYKNRVASRKCRAKFKQLLQHYREVAA-NH2 | 650 |
| 729 | Ac-DSELEIKRYKNRVASRKCRAKFKQLLQHYREVAAA-NH2 | 651 |
| 730 | Desaminotyrosine-FDASISQVNEKINQSLAFIRKSDELLHNVNAGKST-NH2 | 679 |
| 731 | WASLWNW-NH2 | 653 |
| 732 | Ac-EAQQHLLQLTVWGIKQLQARILAVERYLKDQQLLGIWG-NH2 | 654 |
| 733 | Ac-IEAQQHLLQLTVWGIKQLQARILAVERYLKDQQLLGIW-NH2 | 655 |
| 734 | Ac-AIEAQQHLLQLTVWGIKQLQARILAVERYLKDQQLLGI-NH2 | 656 |
| 735 | Ac-RAIEAQQHLLQLTVWGIKQLQARILAVERYLKDQQLLG-NH2 | 657 |
| 736 | Ac-LRAIEAQQHLLQLTVWGIKQLQARILAVERYLKDQQLL-NH2 | 658 |
| 737 | Ac-LLRAIEAQQHLLQLTVWGIKQLQARILAVERYLKDQQL-NH2 | 659 |
| 738 | Ac-NLLRAIEAQQHLLQLTVWGIKQLQARILAVERYLKDQQ-NH2 | 660 |
| 739 | Ac-QNNLLRAIEAQQHLLQLTVWGIKQLQARILAVERYLKD-NH2 | 661 |
| 740 | Ac-QQNNLLRAIEAQQHLLQLTVWGIKQLQARILAVERYLK-NH2 | 662 |

TABLE V-continued

| T No. | Sequence | Seq. ID No. |
|---|---|---|
| 741 | Ac-QQQNNLLRAIEAQQHLLQLTVWGIKQLQARILAVERYL-NH2 | 663 |
| 742 | Ac-VQQQNNLLRAIEAQQHLLQLTVWGIKQLQARILAVERY-NH2 | 664 |
| 743 | Ac-IVQQQNNLLRAIEAQQHLLQLTVWGIKQLQARILAVER-NH2 | 665 |
| 744 | Ac-GIVQQQNNLLRAIEAQQHLLQLTVWGIKQLQARILAVE-NH2 | 666 |
| 745 | Ac-SGIVQQQNNLLRAIEAQQHLLQLTVWGIKQLQARILAV-NH2 | 667 |
| 758 | Ac-RSMTLTVQARQLLSGIVQQQNNLLRAIEAQQHLLQLTV-NH2 | 668 |
| 760 | Ac-GARSMTLTVQARQLLSGIVQQQNNLLRAIEAQQHLLQL-NH2 | 669 |
| 764 | Ac-GSTMGARSMTLTVQARQLLSGIVQQQNNLLRAIEAQQH-NH2 | 670 |
| 765 | Ac-GSTMGARSMTLTVQARQLLSGIVQQQNNLLRAIEAQQH-NH2 | 671 |
| 766 | Ac-EGSTMGARSMTLTVQARQLLSGIVQQQNNLLRAIEAQQ-NH2 | 672 |
| 767 | Ac-RAKFKQLLQHYREVAAAKSSENDRLRLL-NH2 | 673 |
| 768 | Ac-AKFKQLLQHYREVAAAKSSENDRLRLLL-NH2 | 674 |
| 769 | Ac-KFKQLLQHYREVAAAKSSENDRLRLLLK-NH2 | 675 |
| 770 | Ac-FKQLLQHYREVAAAKSSENDRLRLLLKQ-NH2 | 676 |
| 771 | Ac-RAKFKQELQHYREVAAAKSSENDRLRLLLKQMCPS-NH2 | 677 |
| 772 | DKWASLWNWF-NH2 | 678 |
| 773 | Biotin-FDASISQVNEKINQSLAFIRKSDELLHNVNAGKST-NH2 | 679 |
| 774 | Ac-YDASISQVNEKINQSLAFIRKSDELLHNVNAGKST-NH2 | 680 |
| 775 | Ac-YDASISQVNEKINQSLAYIRKSDELLHNVNAGKST-NH2 | 681 |
| 776 | Ac-FDASISQVNEKINQSLAYIRKSDELLHNVNAGKST-NH2 | 682 |
| 777 | Ac-FDASISQVQEKIQQSLAFIRKSDELLHQVQAGKST-NH2 | 683 |
| 778 | Ac-FDASISQVNEKINQALAFIRKADELLHNVNAGKST-NH2 | 684 |
| 779 | Ac-FDASISQVNEKINQALAFIRKSDELLHNVNAGKST-NH2 | 685 |
| 780 | Ac-FDASISQVNEKINQSLAFIRKADELLHNVNAGKST-NH2 | 686 |
| 781 | Ac-YDASISQVQEEIQQALAFIRKADELLEQVQAGKST-NH2 | 687 |
| 782 | Ac-FDASISQVNEKINQSLAFIRKSDELLENVNAGKST-NH2 | 688 |
| 783 | Ac-FDASISQVNEEINQSLAFIRKSDELLHNVNAGKST-NH2 | 689 |
| 784 | Ac-VFPSDEFDASISQVNEKINQSLAFIRKSDELLENV-NH2 | 690 |
| 785 | Ac-VFPSDEFDASISQVNEEINQSLAFIRKSDELLENV-NH2 | 691 |
| 786 | Ac-VYPSDEYDASISQVNEEINQALAYIRKADELLENV-NH2 | 692 |
| 787 | Ac-VFPSDEFDASISQVNEEINQSLAFIRKSDELLHNV-NH2 | 693 |
| 788 | Ac-SNKSLEQIWNNMTWMEWDREINNYTSLIHSLIEESQ-NH2 | 694 |
| 789 | Ac-WSNKSLEQIWNNMTWMEWDREINNYTSLIHSLIEES-NH2 | 695 |
| 790 | Ac-SWSNKSLEQIWNNMTWMEWDREINNYTSLIHSLIEE-NH2 | 696 |
| 791 | Ac-ASWSNKSLEQIWNNMTWMEWDREINNYTSLIHSLIE-NH2 | 697 |
| 792 | Ac-NASWSNKSLEQIWNNMTWMEWDREINNYTSLIHSLI-NH2 | 698 |
| 793 | Ac-WNASWSNKSLEQIWNNMTWMEWDREINNYTSLIHSL-NH2 | 699 |
| 793 | Ac-WNASWSNKSLEQIWNNMTWMEWDREINNYTSLIHSL-NH2 | 699 |
| 794 | Ac-PWNASWSNKSLEQIWNNMTWMEWDREINNYTSLIHS-NH2 | 700 |
| 795 | Ac-VPWNASWSNKSLEQIWNNMTWMEWDREINNYTSLIH-NH2 | 701 |
| 796 | Ac-AVPWNASWSNKSLEQIWNNMTWMEWDREINNYTSLI-NH2 | 702 |
| 797 | Ac-TAVPWNASWSNKSLEQIWNNMTWMEWDREINNYTSL-NH2 | 703 |
| 798 | Ac-TTAVPWNASWSNKSLEQIWNNMTWMEWDREINNYTS-NH2 | 704 |
| 800 | Ac-AAASDEFDASISQVNEKINQSLAFIRKSDELLHNV-NH2 | 706 |
| 801 | Ac-VFPAAAFDASISQVNEKINQSLAFIRKSDELLHNV-NH2 | 707 |
| 802 | Ac-VFPSDEAAASISQVNEKINQSLAFIRKSDELLHNV-NH2 | 708 |
| 803 | Ac-VFPSDEFDAAAAQVNEKINQSLAFIRKSDELLHNV-NH2 | 709 |
| 804 | Ac-VFPSDEFDASISAAAEKINQSLAFIRKSDELLHNV-NH2 | 710 |
| 805 | Ac-VFPSDEFDASISQVNAAANQSLAFIRKSDELLHNV-NH2 | 711 |
| 806 | Ac-VFPSDEFDASISQVNEKIAAALAFIRKSDELLHNV-NH2 | 712 |
| 807 | Ac-VFPSDEFDASISQVNEKINQSAAAIRKSDELLHNV-NH2 | 713 |
| 808 | Ac-VFPSDEFDASISQVNEKINQSLAFAAASDELLHNV-NH2 | 714 |
| 809 | Ac-VFPSDEFDASISQVNEKINQSLAFIRKAAALLHNV-NH2 | 715 |
| 810 | Ac-VFPSDEFDASISQVNEKINQSLAFIPKSDEAAANV-NH2 | 716 |
| 811 | Ac-VFPSDEFDASISQVNEKINQSLAFIRKSDELLAAA-NH2 | 717 |
| 812 | Ac-VYPSDEFDASISQVNEKINQSLAFIPKSDELLHNV-NH2 | 718 |
| 813 | Ac-AAAAIHSLIEESQNQQEKNEQELLELDKWASLWNWF-NH2 | 719 |
| 814 | Ac-YTSLIHSLIEESQQQQEKNEQELLELDKWASLWNWF-NH2 | 720 |
| 815 | Ac-YTSLIHSLIEESQNQQEKQEQELLELDKWASLWNWF-NH2 | 721 |
| 816 | Ac-QIWNNMTWMEWDREINNYTSLIHSLIEESQNQQEKQ-NH2 | 722 |
| 817 | Ac-QIWNNMTWMEWDREINNYTSLIHSLIEESQQQQEKN-NH2 | 723 |
| 818 | Ac-QIWNNMTWMEWDREINNYTSLIHSLIEESQQQQEKQ-NH2 | 724 |
| 819 | Ac-NKSLEQIWNNMTWMEWDREINNYTSLIHSLIEESQQ-NH2 | 725 |
| 820 | Ac-FDASISQVNEKINQSLAFIEESDELLHNVNAGKST-NH2 | 726 |
| 821 | Ac-ACIRKSDELCL-NH2 | 727 |
| 823 | Ac-YTSLIHSLIEESQNQQEKDEQELLELDKWASLWNWF-NH2 | 728 |
| 824 | Ac-YTSLIHSLIEESQDQQEKNEQELLELDKWASLWNWF-NH2 | 729 |
| 825 | Ac-YTSLIHSLIEESQDQQEKDEQELLELDKWASLWNWF-NH2 | 730 |
| 826 | Ac-YTSLIHSLIEESQNQQEKNEQELLELDKWASLWDWF-NH2 | 731 |
| 841 | Ac-LEANITQSLEQAQIQQEKNMYELQKLNSWDVFTNWL-NH2 | 732 |
| 842 | Ac-LEANISASLEQAQIQQEKNMYELQKLNSWDVFTNWL-NH2 | 733 |
| 843 | Ac-LEANISALLEQAQIQQEKNMYELQKLNSWDVFTNWL-NH2 | 734 |
| 844 | Ac-LEANITALLEQAQIQQEKNMYELQKLNSWDVFTNWL-NH2 | 735 |
| 845 | Ac-LEANITASLEQAQIQQEKNMYELQKLNSWDVFTNWL-NH2 | 736 |
| 845 | Ac-LEANITASLEQAQIQQEKNMYELQKLNSWDVFTNWL-NH2 | 736 |
| 846 | Ac-RAKFKQLLQHYREVAAAKSSENDRLRLLLKQMUPS-NH2 | 1914 |

TABLE V-continued

| T No. | Sequence | Seq. ID No. |
|---|---|---|
| 847 | Ac-Abu-DDE-Abu-MNSVKNGTYDYPKYEEESKLNRNEIKGVKL-NH2 | 1915 |
| 856 | Ac-WQEWEQKVRYLEANISQSLEQAQIQQEKNMYELQKL-NH2 | 739 |
| 860 | Ac-DEYDASISQVNEKINQSLAFIRKSDELLHNVNAGK-NH2 | 740 |
| 861 | Ac-YTSLIHSLIEESQNQQEKNEQELLELDKWASLWN-NH2 | 741 |
| 862 | Ac-YTSLIHSLIEESQNQQEKNEQELLELDKWASLW-NH2 | 742 |
| 863 | Ac-YTSLIHSLIEESQNQQEKNEQELLELDKWASL-NH2 | 743 |
| 864 | Ac-YTSLIHSLIEESQNQQEKNEQELLELDKWAS-NH2 | 744 |
| 865 | Ac-QARQLLSGIVQQQNNLLRAIEAQQHLLQLTVWGIKQLQARILAVERYLKDQ-NH2 | 745 |
| 866 | Ac-DREINNYTSLIHSLIEESQNQQEKNEQELLELDKWASLWNWF-NH2 | 746 |
| 867 | Ac-NNMTWMEWDREINNYTSLIHSLIEESQNQQEKNEQELLELDK-NH2 | 747 |
| 868 | Ac-YTSLIHSLIEESQNQQEKNEQELLELDKWASLWAAA-NH2 | 748 |
| 869 | Ac-YTSLIHSLIEESQNQQEKNEQELLELDKWAAAANWF-NH2 | 749 |
| 870 | Ac-YTSLIHSLIEESQNQQEKNEQELLELDAAASLWNWF-NH2 | 750 |
| 871 | Ac-YTSLIHSLIEESQNQQEKNEQELLAAAKWASLWNWF-NH2 | 751 |
| 872 | Ac-YTSLIHSLIEESQNQQEKNEQAAAELDKWASLWNWF-NH2 | 752 |
| 873 | Ac-YTSLIHSLIEESQNQQEKAAAELLELDKWASLWNWF-NH2 | 753 |
| 874 | Ac-YTSLIHSLIEESQNQAAANEQELLELDKWASLWNWF-NH2 | 754 |
| 875 | Ac-YTSLIHSLIEESAAAQEKNEQELLELDKWASLWNWF-NH2 | 755 |
| 876 | Ac-YTSLIHSLIAAAQNQQEKNEQELLELDKWASLWNWF-NH2 | 756 |
| 877 | Ac-YTSLIHAAAEESQNQQEKNEQELLELDKWASLWNWF-NH2 | 757 |
| 878 | Ac-YTSAAASLIEESQNQQEKNEQELLELDKWASLWNWF-NH2 | 758 |
| 879 | Ac-EIWNNMTWMEWDRENEKINQSLAFIRKSDELLHNV-NH2 | 759 |
| 880 | Ac-YISEVNEEINQSLAFIRKADELLENVDKWASLWNWF-NH2 | 760 |
| 881 | Ac-TSVITIELSNIKENKANGTDAKVKLIKQELDKYKN-NH2 | 761 |
| 882 | YTSLIHSLIEESQNQQEKNEQELLELDKWASLWNWFMG-NH2 | 762 |
| 883 | Ac-NEKINQSLAFIRKSDELLHNV-NH2 | 763 |
| 884 | Biotin-YDPLVFPSDEFDASISQVNEKINQSLAFIRKSDEL-NH2 | 764 |
| 885 | Biotin-PLVFPSDEFDASISQVNEKINQSLAFIRKSDELLH-NH2 | 765 |
| 886 | Biotin-VFPSDEFDASISQVNEKINQSLAFIRKSDELLHNV-NH2 | 766 |
| 887 | Biotin-DEFDASISQVNEKINQSLAFIRKSDELLHNVNAGK-NH2 | 767 |
| 888 | Biotin-VYPSDEFDASISQVNEKINQSLAFIRKSDELLHNV-NH2 | 768 |
| 889 | Biotin-VYPSDEYDASISQVNEEINQALAYIRKADELLENV-NH2 | 769 |
| 890 | Ac-VYPSDEFDASISQVQEEIQQALAFIRKADELLEQV-NH2 | 770 |
| 891 | Ac-NYTSLIHSLIEESQNQQEKNEQELLELDKWASLWNWF-NH2 | 771 |
| 892 | Ac-NNYTSLIHSLIEESQNQQEKNEQELLELDKWASLWNWF-NH2 | 772 |
| 893 | Ac-INNYTSLIHSLIEESQNQQEKNEQELLELDKWASLWNWF-NH2 | 773 |
| 894 | Ac-EINNYTSLIHSLIEESQNQQEKNEQELLELDKWASLWNWF-NH2 | 774 |
| 895 | Ac-YTSLIHSLIEESQNQQEKNEQELLELDKWASLWNWFN-NH2 | 775 |
| 896 | Ac-YTSLIHSLIEESQNQQEKNEQELLELDKWASLWNWFNI-NH2 | 776 |
| 897 | Ac-YTSLIHSLIEESQNQQEKNEQELLELDKWASLWNWFNIT-NH2 | 777 |
| 898 | Ac-YTSLIHSLIEESQNQQEKNEQELLELDKWASLWNWFNITN-NH2 | 778 |
| 899 | Ac-YDPLVFPSDEFDASISQVNEKINQSLAFIRKSDELLHNVNAGK-NH2 | 779 |
| 900 | Ac-NYTSLIHSLIEESQNQQEKNEQELLELDKWASLWNWFN-NH2 | 780 |
| 901 | Ac-NNYTSLIHSLIEESQNQQEKNEQELLELDKWASLWNWFNI-NH2 | 781 |
| 905 | Ac-KCRAKFKQLLQHYREVAAAKSSENDRLPLLLKQMCPSLDVDSIIPRTPD-NH2 | 782 |
| 906 | Ac-RAKFKQLLQHYREVAAAKSSENDRLRLLLKQMCPSLDVDSIIPRTPD-NH2 | 783 |
| 907 | Ac-VYPSDEYDASISQVNEEINQALAYIAAADELLENV-NH2 | 784 |
| 909 | Ac-YDASISQVNEEINQALAYIRKADELL-NH2 | 785 |
| 910 | Ac-M-Nle-WMEWDREINNYTSLIHSLIEESQNQQEKNEQELLEL-NH2 | 1916 |
| 911 | Ac-KNGTYDYPKYEEESKLNRNEIKGVKLSSMGVYQI-NH2 | 787 |
| 912 | Ac-VTEKIQMASDNINDLIQSGVNTRLLTIQSHVQNYI-NH2 | 788 |
| 913 | QNQQEKNEQELLELDKWASLWNWF-NH2 | 789 |
| 914 | Ac-QNQQEKNEQELLELDKWASLWNWF-NH2 | 790 |
| 915 | LWNWF-NH2 | 791 |
| 916 | ELLELDKWASLWNWF-NH2 | 792 |
| 917 | EKNEQELLELDKWASLWNWF-NH2 | 793 |
| 918 | SLIEESQNQQEKNEQELLELDKWASLWNWF-NH2 | 794 |
| 919 | Ac-YTSLIHSLIEESQNQQEKNEQELLELDKWASLWNW | 795 |
| 920 | Ac-YTSLIHSLIEESQNQQEKNEQELLELDKWASLWN | 796 |
| 921 | Ac-YTSLIHSLIEESQNQQEKNEQELLELDKWASLW | 797 |
| 922 | Ac-YTSLIHSLIEESQNQQEKNEQELLELDKWASL | 798 |
| 923 | TSLIHSLIEESQNQQEKNEQELLELDKWASLWNWF-NH2 | 799 |
| 924 | SLIHSLIEESQNQQEKNEQELLELDKWASLWNWF-NH2 | 800 |
| 925 | LIHSLIEESQNQQEKNEQELLELDKWASLWNWF-NH2 | 801 |
| 926 | IHSLIEESQNQQEKNEQELLELDKWASLWNWF-NH2 | 802 |
| 940 | Ac-AAVALLPAVLLALLAPSELEIKRYKNRVASRKCRAKFKQLLQHYREVAAAK-NH2 | 803 |
| 941 | Ac-AAVALLPAVLLALLAPCRAKFKQLLQHYREVAAAKSSENDRLRLLLKQMCP-NH2 | 804 |
| 942 | Ac-YTSLIHSLIEESQNQQEKNNNIERDWEMWTMNNWIQ-NH2 | 805 |
| 944 | VYPSDEYDASISQVNEEINQALAYIRKADELLENV-NH2 | 806 |
| 945 | Ac-LMQLARQLMQLARQMKQLADSLMQLARQVSRLESA-NH2 | 807 |
| 946 | Ac-WMEWDREINNYTSLIHSLIEESQNQQEKNEQELL-NH2 | 808 |
| 947 | Ac-MEWDREINNYTSLIHSLIEESQNQQEKNEQELLEL-NH2 | 809 |
| 948 | Ac-EWDREINYYTSLLHSLIEESQNQQEKNEQELLEL-NH2 | 810 |
| 949 | Ac-MEWDREINNYTSLIHSLIEESQNQQEKNEQELLE-NH2 | 811 |
| 950 | Biotin-W-Nle-EWDREINNYTSLIHSLIEESQNQQEKNEQELLEL-NH2 | 1917 |
| 951 | Ac-YLEYDREINYYTSLIHSLIEESQNQQEKNEQELLEL-NH2 | 813 |

TABLE V-continued

| T No. | Sequence | Seq. ID No. |
|---|---|---|
| 952 | Ac-IKQFINMWQEVGKAMYA-NH2 | 814 |
| 953 | Ac-IRKSDELL-NH2 | 815 |
| 954 | Decanoyl-IRKSDELL-NH2 | 815 |
| 955 | Acetyl-Aca-Aca-IRKSDELL-NH2 | 1918 |
| 956 | Ac-YDASISQV-NH2 | 816 |
| 957 | Ac-NEKINQSL-NH2 | 817 |
| 958 | Ac-SISQVNEEINQALAYIRKADELL-NH2 | 818 |
| 959 | Ac-QVNEEINQALAYIRKADELL-NH2 | 819 |
| 960 | Ac-EEINQALAYIRKADELL-NH | 820 |
| 961 | Ac-NQALAYIRKADELL-NH2 | 821 |
| 962 | Ac-LAYIRKADELL-NH2 | 822 |
| 963 | FDASISQVNEKINQALAFIRKSDELL-NH2 | 823 |
| 964 | Ac-W-Nle-EWDREINNYTSLIHSLIEESQNQQEKNEQELLEL-NH2 | 1919 |
| 965 | Ac-ASRKCRAKFKQLLQHYREVAAAKSSENDRLRLLLKQMCPSLDVDS-NH2 | 825 |
| 967 | Ac-WLEWDREINNYTSLIHSLIEESQNQQEKNEQELLEL-NH2 | 827 |
| 968 | Ac-YVKGEPIINFYDPLVFPSDEFDASISQVNEKINQSL-NH2 | 828 |
| 969 | Ac-VYPSDEYDASISQVNEEINQSLAYIRKADELLHNV-NH2 | 829 |
| 970 | Ac-YDASISQVNEEINQALAYIRKADELLENV-NH2 | 830 |
| 971 | Ac-YDASISQVNEEINQALAYIRKADELLE-NH2 | 831 |
| 972 | Ac-VYPSDEYDASISQVNEEINQALAYIRKAAELLHNV-NH2 | 832 |
| 973 | Ac-VYPSDEYDASISQVNEEINQALAYIRKALELLHNV-NH2 | 833 |
| 974 | Decanoyl-YTSLIHSLIEESQNQQEKNEQELLELDKWASLWNWF-NH2 | 834 |
| 975 | Ac-VYPSDEYDASISQVNEEINQLLAYIRKLDELLENV-NH2 | 835 |
| 976 | Ac-DEYDASISQVNEKINQSLAFIRKSDELL-NH2 | 836 |
| 977 | Ac-SNDQGSGYAADKESTQKAFDGITNKVNSVIEKTNT-NH2 | 837 |
| 978 | Ac-ESTQKAFDGITNKVNSVIEKTNTQFEAVGKEFGNLEKR-NH2 | 838 |
| 979 | Ac-DGITNKVNSVIEKTNTQFEAVGKEFGNLEKRLENLNK-NH2 | 839 |
| 980 | Ac-DSNVKNLYDKVRSQLRDNVKELGNGAFEFYHK-NH2 | 840 |
| 981 | Ac-RDNVKELGNGAFEFYHKADDEALNSVKNGTYDYPKY-NH2 | 841 |
| 982 | Ac-EFYHKADDEALNSVKNGTYDYPKY-NH2 | 842 |
| 983 | Ac-AAVALLPAVLLALLAPAADKESTQKAFDGITNKVNS-NH2 | 843 |
| 984 | Ac-AAVALLPAVLLALLAPAADSNVKNLYDKVRSQLRDN-NH2 | 844 |
| 985 | Ac-KESTQKAFDGITNKVNSV-NH2 | 845 |
| 986 | Ac-IEKTNTQFEAVGKEFGNLER-NH2 | 846 |
| 987 | Ac-RLENLNKRVEDGFLDVWTYNAELLVALENE-NH2 | 847 |
| 988 | Ac-SNVKNLYDKVRSQLRDN-NH2 | 848 |
| 989 | Ac-WMEWDREINNYTSLIHSLIEESQNQQEKNEQEL-NH2 | 849 |
| 990 | Ac-WMEWDRENNYTSLIHSLIEESQNQQEKNEQE-NH2 | 850 |
| 991 | Ac-MEWDREINNYTSLIHSLIEESQNQQEKNEQEL-NH2 | 851 |
| 992 | Ac-MEWDREINNYTSLIHSLIEESQNQQEKNEQE-NH2 | 852 |
| 993 | Ac-EWDREINNYTSLIHSLIEESQNQQBKNEQELLE-NH2 | 853 |
| 994 | Ac-EWDREINNYTSLIHSLIEESQNQQEKNEQELL-NH2 | 854 |
| 995 | Ac-EWDRENNYTSLIHSLIEESQNQQEKNEQEL-NH2 | 855 |
| 996 | Ac-YTKFIYTLLEESQNQQEKNEQELLELDKWASLWNWF-NH2 | 856 |
| 997 | Ac-YMKQLADSLMQLARQVSRLESA-NH2 | 857 |
| 998 | Ac-YLMQLARQMKQLADSLMQLARQVSRLESA-NH2 | 858 |
| 999 | Ac-YQEWERKVDFLEENITALLEEAQIQQEKNMYELQKL-NH2 | 859 |
| 1000 | Ac-WMAWAAAINNYTSLIHSLIEESQNQQEKNEQEEEEE-NH2 | 860 |
| 1001 | Ac-YASLIAALIEESQNQQEKNEQELLELAKWAALWAWF-NH2 | 861 |
| 1002 | [Ac-EWDREINNYTSLIHSLIEESQNQQEKNEQEGGC-NH2]dimer | 862 |
| 1003 | Ac-YDISIELNKAKSDLEESKEWIKKSNQKLDSIGNWH-NH2 | 863 |
| 1004 | Biotinyl-IDISIELNKAKSDLEESKEWIKKSNQKLDSIGNWH-NH2 | 548 |
| 1005 | Ac-YTSLI-OH | 865 |
| 1006 | Fmoc-HSLIEE-OH | 866 |
| 1007 | Fmoc-SQNQQEK-OH | 867 |
| 1008 | Fmoc-NEQELLEL-OH | 868 |
| 1009 | Fmoc-DKWASL-OH | 869 |
| 1010 | Fmoc-WNWF-OH | 870 |
| 1011 | Ac-AKTLERTWDTLNHLLFISSALYKLNLKSVAQITLSI-NH2 | 871 |
| 1012 | Ac-NITLQAKIKQFINMWQEVGKAMYA-NH2 | 872 |
| 1013 | Ac-LENERTLDFHDSNVKNLYDKVRLQLRDN-NH2 | 873 |
| 1014 | Ac-LENERTLDFHDSNVKNLYDKVRLQLRDNVKELGNG-NH2 | 874 |
| 1015 | Ac-TLDFHDSNVKNLYDKVRLQLRDNVKELGNGAFEF-NH2 | 875 |
| 1016 | Ac-IDISIELNKAKSDLEESKEWIKKSNQKLDSIGNWH-NH2 | 548 |
| 1021 | Biotinyl-SISQVNEEINQALAYIRKADELL-NH2 | 877 |
| 1022 | Biotinyl-SISQVNEEINQSLAYIRKSDELL-NH2 | 878 |
| 1023 | Ac-SISQVNEEINQSLAYIRKSDELL-NH2 | 879 |
| 1024 | Ac-IDISIELNKAKSDLEESKEWIEKSNQELDSIGNWE-NH2 | 39 |
| 1025 | Ac-IDISIELNKAKSDLEESKEWIKKSNQELDSIGNWH-NH2 | 864 |
| 1026 | Ac-IDISIELNKAKSDLEEAKEWIDDANQKLDSIGNWH-NH2 | 1920 |
| 1027 | Ac-IDISIELNKAKSDLEESKEWIKKANQKLDSIGNWH-NH2 | 80 |
| 1028 | Ac-IDISIELNKAKSDLEEAKEWIKKSNQKLDSIGNWH-NH2 | 548 |
| 1029 | Biotinyl-NSVALDPIDISIELNKAKSDLEESKEWIKKSNQKL-NH2 | 880 |
| 1030 | Biotinyl-ALDPIDISIELNKAKSDLEESKEWIKKSNQKLDSI-NH2 | 881 |
| 1031 | desAminoTyrosine-NSVALDPIDISIELNKAKSDLEESKEWIKKSNQKL-NH2 | 882 |
| 1032 | desAminoTyrosine-ALDPIDISIELNKAKSDLEESKEWIKKSNQKLDSI-NH2 | 883 |

TABLE V-continued

| T No. | Sequence | Seq. ID No. |
|---|---|---|
| 1033 | Ac-YDASISQVNEEINQALAFIRKADEL-NH2 | 1921 |
| 1034 | Ac-YDASISQVNEEINQSLAYIRKADELL-NH2 | 1922 |
| 1035 | Biotinyl-YDASISQVNEEINQALAYIRKADELL-NH2 | 890 |
| 1036 | Biotinyl-YDASISQVNEEINQSLAFIRKSDELL-NH2 | 885 |
| 1037 | Ac-YDASISQVNEEINQSLAFIRKSDELL-NH2 | 885 |
| 1038 | Ac-WLEWDREINNYTSLLHSLIEESQNQQEKNEQEL-NH2 | 887 |
| 1039 | Biotinyl-IDISIELNKAKSDLEESKEWIRRSNQKLDSIGNWH-NH2 | 888 |
| 1044 | Ac-YESTQKAFDGITNKVNSVIEKTNTQFEAVGKEFGNLEKR-NH2 | 81 |
| 1045 | Biotin-DEYDASISQVNEKINQSLAFIRKSDELL-NH2 | 82 |
| 1046 | Ac-MEWDREINNYTSLIHSLIEESQNQQEKNEQELL-NH2 | 571 |
| 1047 | Ac-WQEWEQKVRYLEANISQSLEQAQIQQEKNMYEL-NH2 | 892 |
| 1048 | Ac-WQEWEQKVRYLEANISQSLEQAQIQQEKNEYEL-NH2 | 893 |
| 1049 | Ac-WQEWEQKVRYLEANITALLEQAQIQQEKNEYEL-NH2 | 894 |
| 1050 | Ac-WQEWEQKVRYLEANITALLEQAQIQQEKNMYEL-NH2 | 895 |
| 1051 | Ac-WQEWEQKVRYLEANISQSLEQAQIQQEKNEYELQKL-NH2 | 896 |
| 1052 | Ac-WQEWEQKVRYLEANITALLEQAQIQQEKNEYELQKL-NH2 | 897 |
| 1053 | Ac-WQEWEQKVRYLEANITALLEQAQIQQEKNMYELQKL-NH2 | 898 |
| 1054 | Ac-IDISIELNKAKSDLEESKEWIEKSNQKLDSIGNWH-NH2 | 1923 |
| 1055 | Ac-EFGNLEKRLENLNKRVEDGFLDVWTYNAELLVALENE-NH2 | 899 |
| 1056 | Ac-EDGFLDVWTYNAELLVLMENERTLDFHDSNVKNLYDKVRMQL-NH2 | 900 |
| 1057 | Ac-SISQVNEKINQSLAFIRKSDELL-NH2 | 901 |
| 1058 | desaminoTyr-SISQVNEKINQSLAFIRKSDELL-NH2 | 902 |
| 1059 | Ac-SISQVNEKINQSLAYIRKSDELL-NH2 | 903 |
| 1060 | Ac-QQLLDVVKRQQEMLRLTVWGTKNLQARVTAIBKYLKDQ-NH2 | 904 |
| 1061 | YTSLIHSLIEESQNQQEKNEQELLELDKWASLWNWFC | 905 |
| 1062 | Ac-FDASISQVNEKINQSLAYIRKSDELL-NH2 | 906 |
| 1063 | Ac-YTSLIHSLIEESQNQQEKNEQELLELDKWA | 907 |
| 1064 | Indole-3-acetyl-DEFDASISQVNEKINQSLAFIRKSDELL-NH2 | 908 |
| 1065 | Indole-3-acetyl-DEFDESISQVNEKINQSLAFIRKSDELL-NH2 | 909 |
| 1066 | Indole-3-acetyi-DEFDESISQVNEKIEQSLAFIRKSDELL-NH2 | 910 |
| 1067 | IndoIe-3-acetyi-DEFDESISQVNEKIEESLAFIRKSDELL-NH2 | 911 |
| 1068 | Indoie-3-acetyi-DEFDESISQVNEKIEESLQFIRKSDELL-NH2 | 912 |
| 1069 | Indole-3-acetyl-GGGGGDEFDASISQVNEKINQSLAFIRKSDELL-NH2 | 913 |
| 1070 | 2-Napthoyl-DEFDASISQVNEKINQSLAFIRKSDELL-NH2 | 914 |
| 1071 | desNH2Tyr-DEFDASISQVNEKINQSLAFIRKSDFLL-NH2 | 915 |
| 1072 | biotin-ALDPIDISIELNKAKSDLEESKEWIRRSNQKLDSI-NH2 | 916 |
| 1073 | Ac-YDASISQVNEKINQALAYIRKADELLHNVNAGKST-NH2 | 917 |
| 1074 | Ac-VYPSDEYDASISQVNEKINQALAYIRKADELLHNV-NH2 | 918 |
| 1075 | Ac-VYPSDEYDASISQVNEKINQSLAYIRKSDELLHNV-NH2 | 1924 |
| 1076 | Ac-WGWGYGYG-NH2 | 919 |
| 1077 | Ac-YGWGWGWGF-NH2 | 920 |
| 1078 | Ac-WQEWEQKVRYLEANITALQEQAQIQAEKAEYELQKL-NH2 | 921 |
| 1079 | Ac-WQEWEQKVRYLEAEITALQEEAQIQAEKAEYELQKL-NH2 | 922 |
| 1081 | Ac-YTSLIHSLIEESQNQQEKNEQELLELDKWAS | 923 |
| 1082 | Ac-VWPSDEFDASISQVNEKINQSLAFIRKSDELLHNV-NH2 | 924 |
| 1083 | Ac-SKNISEQIDQIKKDEQKEGTGWGLGGKWWTSDWGV-NH2 | 925 |
| 1084 | Ac-LSKNISEQIDQIKKDEQKEGTGWGLGGKWWTSDWG-NH2 | 926 |
| 1085 | Ac-DLSKNISBQIDQIKKDEQKEGTGWGLGGKWWTSDW-NH2 | 927 |
| 1086 | Ac-EDLSKNISEQIDQIKKDEQKEGTGWGLGGKWWTSD-NH2 | 928 |
| 1087 | Ac-IEDLSKNISEQIDQIKKDEQKEGTGWGLGGKWWTS-NH2 | 929 |
| 1088 | Ac-GIEDLSKNISEQIDQIKKDEQKEGTGWGLGGKWWT-NH2 | 930 |
| 1089 | Ac-IGIEDLSKNISEQIDQIKKDEQKEGTGWGLGGKWW-NH2 | 931 |
| 1090 | 2-Napthoyl--PSDEFDASISQVNEKINQSLAFIRKSDELLHNVN-NH2 | 932 |
| 1091 | Ac-VYPSDEYDASISQVNEKINQALAYIRKADELLENV-NH2 | 933 |
| 1092 | Ac-VYPSDEFDASISQVNEKINQALAFIRKADELLENV-NH2 | 934 |
| 1093 | Ac-VYPSDEYDASISQVNEKINQALAYIREADELLENV-NH2 | 935 |
| 1094 | Biotinyl-YDASISQVNBKINQSLAFIRESDELL-NH2 | 936 |
| 1095 | Ac-AIGIEDLSKNISEQIDQIKKDEQKEGTGWGLGGKW-NH2 | 937 |
| 1096 | Ac-AAIGIEDLSKNISEQIDQIKKDEQKEGTGWGLGGK-NH2 | 938 |
| 1097 | Ac-DAAIGIEDLSKNISEQIDQIKKDEQKEGTGWGLGG-NH2 | 939 |
| 1098 | Ac-PDAAIGIEDLSKNISEQIDQIKKDEQKEGTGWGLG-NH2 | 940 |
| 1099 | Ac-NITDKIDQIIHDFVDKTLPDQGDNDNWWTGWRQWI-NH2 | 941 |
| 1100 | Ac-KNITDKIDQIIHDFVDKTLPDQGDNDNWWTGWRQW-NH2 | 942 |
| 1101 | Ac-TKNITDKIDQIIHDFVDKTLPDQGDNDNWWTGWRQ-NH2 | 943 |
| 1102 | Ac-WTKNITDKIDQIIHDFVDKTLPDQGDNDNWWTGWR-NH2 | 944 |
| 1103 | Ac-DWTKNITDKIDQIIHDFVDKTLPDQGDNDNWWTGW-NH2 | 945 |
| 1104 | Ac-HDWTKNITDKIDQIIHDFVDKTLPDQGDNDNWWTG-NH2 | 946 |
| 1105 | Ac-PHDWTKNITDKIDQIIHDFVDKTLPDQGDNDNWWT-NH2 | 947 |
| 1106 | Ac-EPHDWTKNITDKIDQIIHDFVDKTLPDQGDNDNWW-NH2 | 948 |
| 1107 | Ac-IEPHDWTKNITDKIDQIIHDFVDKTLPDQGDNDNW-NH2 | 949 |
| 1108 | Ac-AIEPHDWTKNITDKIDQIIHDFVDKTLPDQGDNDN-NH2 | 950 |
| 1109 | Ac-AAIEPHDWTKNITDKIDQIIHDFVDKTLPDQGDND-NH2 | 951 |
| 1110 | Ac-DAAIEPHDWTKNITDKIDQIIHDFVDKTLPDQGDN-NH2 | 952 |
| 1111 | Ac-LSPTVWLSVIWMMWYWGPSLYSILSPFLPLLPIFF-NH2 | 953 |
| 1112 | Ac-GLSPTVWLSVIWMMWYWGPSLYSILSPFLPLLPIF-NH2 | 1345 |
| 1113 | Ac-VGLSPTVWLSVIWMMWYWGPSLYSILSPFLPLLPI-NH2 | 1346 |

TABLE V-continued

| T No. | Sequence | Seq. ID No. |
|---|---|---|
| 1114 | Ac-FVGLSPTWLSVIWMMWYWGPSLYSILSPFLPLLP-NH2 | 1347 |
| 1115 | Ac-WFVGLSPTVWLSVIWMMWYWGPSLYSILSPFLPLL-NH2 | 1348 |
| 1116 | Ac-QWFVFLSPTVWLSVIWMMWYWGPSLYSILSPFLPL-NH2 | 1925 |
| 1117 | Ac-VQWFVGLSPTVWLSVIWMMWYWGPSLYSILSPFLP-NH2 | 1350 |
| 1118 | Ac-FVQWFVGLSPTVWLSVIWMMWYWGPSLYSILSPFL-NH2 | 1351 |
| 1119 | Ac-PFVQWFVGLSPTVWLSVIWMMWYWGPSLYSILSPF-NH2 | 1352 |
| 1120 | Ac-VPFVQWFVGLSPTVWLSVIWMMWYWGPSLYSILSP-NH2 | 1353 |
| 1121 | Ac-LVPFVQWFVGLSPTVWLSVIWMMWYWGPSLYSILS-NH2 | 1354 |
| 1122 | H-NHTTVVMEWDREINNYTSLIHSLIEESQNQQEKNEQELLELDKW-OH | 954 |
| 1123 | H-QARQLLSGIVQQQNNLLRAIEAQQHLLQLTVWGIKQLQARILAVERYLKDQ-OH | 955 |
| 1124 | Ac-VYPSDEFDASISQVNEKINQSLAFIREADELLENV-NH2 | 956 |
| 1125 | Ac-VFPSDEFDASISQVNEKINQSLAYIREADELLENV-NH2 | 957 |
| 1126 | Ac-DEFDASISQVNEKINQSLAYIREADELL-NH2 | 958 |
| 1127 | Ac-NEQELLELDKWASLWNWFGGGGDEFDASISQVNEKINQSLAFIRKSDELL-NH2 | 959 |
| 1128 | Ac-LELDKWASLWNWFGGGGDEFDASISQVNEKINQSLAFIRKSDELL-NH2 | 960 |
| 1129 | Naphthoyl-EGEGEGEGDEFDASISQVNEKINQSLAFIRKSDELL-NH2 | 961 |
| 1130 | Ac-ASRKCPAKFKQLLQHYREVAAAKSSENDRLRLLLKQMCPSLDV-NH2 | 962 |
| 1131 | Naphthoyl-GDEEDASISQVNEKINQSLAFIRKSDELL-NH2 | 963 |
| 1132 | Naphthoyl-GDEEDASESQVNEKINQSLAFIRKSDELL-NH2 | 964 |
| 1133 | Naphthoyl-GDEEDASESQQNEKINQSLAFIRKSDELL-NH2 | 965 |
| 1134 | Naphthoyl-GDEEDASESQQNEKQNQSLAFIRKSDELL-NH2 | 966 |
| 1135 | Naphthoyl-GDEEDASESQQNEKQNQSEAFIRKSDELL-NH2 | 967 |
| 1136 | Ac-WGDEFDESISQVNEKIEESLAFIRKSDELL-NH2 | 968 |
| 1137 | Ac-YTSLGGDEFDESISQVNEKIEESLAFIRKSDELLGGWNWF-NH2 | 969 |
| 1138 | Ac-YTSLIHSLGGDEFDESISQVNEKIEESLAFIRKSDELLGGWASLWNWF-NH | 970 |
| 1139 | 2-Naphthoyl-GDEFDESISQVNEKIEESLAFIRKSDELL-NH2 | 971 |
| 1140 | 2-Naphthoyl-GDEEDESISQVNEKIEESLAFIRKSDELL-NH2 | 972 |
| 1141 | 2-Naphthoyl-GDEEDESISQVQEKIEESLAFIRKSDELL-NH2 | 973 |
| 1142 | 2-Naphthoyl-GDEEDESISQVQEKIEESLLFIRKSDELL-NH2 | 974 |
| 1143 | Biotin-GDEYDESISQVNEKIEESLAFIRKSDELL-NH2 | 975 |
| 1144 | 2-Naphthoyl-GDEYDESISQVNEKIEESLAFIRKSDELL-NH2 | 976 |
| 1145 | Ac-YTSLIHSLIDEQEKIEELAFIRKSDELLELDKWNWF-NH2 | 977 |
| 1146 | VYPSDEYDASISQVNEEINQALAYIRKADELLENV-NH2 | 978 |
| 1147 | Ac-NNLLRAIEAQQHLLQLTVWGSKQLQARILAVERYLKDQ-NH2 | 979 |
| 1148 | GGGVYPSDEYDASISQVNEEINQALAYIRKADELLENV-NH2 | 980 |
| 1149 | Ac-NNLLRAIEAQQHLLQLTVWGEKQLQARILAVERYLKDQ-NH2 | 981 |
| 1150 | Ac-PTRVNYILIIGVLVLAbuEVTGVRADVHLL-NH2 | 1926 |
| 1151 | Ac-PTRVNYILIIGVLVLAbUEVTGVRADVHLLEQPGNLW-NH2 | 1927 |
| 1152 | Ac-PEKTPLLPTRVNYILIIGVLVLAbuEVTGVRADVHLL-NH2 | 1928 |
| 1153 | AhaGGGVYPSDEYDASISQVNEEINQALAYIRKADELLENV-NH2 | 1929 |
| 1155 | Ac-YTSLIHSLGGDEFDESISQVNEKIEESLAFIRKSDELL-NH2 | 986 |
| 1156 | Ac-YTSLGGDEFDESISQVNEKIEESLAFIRKSDELL-NH2 | 987 |
| 1157 | Ac-DEFDESISQVNEKIEESLAFIRKSDELLGGWASLWNWF-NH2 | 988 |
| 1158 | Ac-DEFDESISQVNEKIEESLAFIRKSDELLGGWNWF-NH2 | 989 |
| 1159 | Ac-YTSLIHSLIEESQNQQEKNEQELLELDKASLWNWF-NH2 | 990 |
| 1160 | Ac-YTSLIHSLIEESQNQQEKNEQELLELDKSLWNWF-NH2 | 991 |
| 1161 | Ac-YTSLIHSLIEESQNQQEKNEQELLELDKLWNWF-NH2 | 992 |
| 1162 | Ac-YTSLIHSLIEESQNQQEKNEQELLELDKWNWF-NH2 | 993 |
| 1163 | Ac-MTWMEWDREINNYTSLIHSLIEESQNQQEKNEQELLELDKASLWNWF-NH2 | 994 |
| 1164 | Ac-MTWMEWDREINNYTSLIHSLIEESQNQQEKNEQELLELDKSLWNWF-NH2 | 995 |
| 1165 | Ac-MTWMEWDREINNYTSLIHSLIEESQNQQEKNEQELLELDKLWNWF-NH2 | 996 |
| 1166 | Ac-MTWMEWDREINNYTSLIHSLIEESQNQQEKNEQELLELDKWNWF-NH2 | 997 |
| 1167 | Ac-MTWMEWDREINNYTSLIRSLIEESQNQQEKNEQELLELDKWASLWN-NH2 | 998 |
| 1168 | Ac-MTWMEWDREINNYTSLIHSLIEESQNQQEKNEQELLELDKWASL-NH2 | 999 |
| 1169 | (Pyr)HWSY(2-napthyl-D-Ala)LRPG-NH2 | 1930 |
| 1170 | Ac-WNWFDEFDESISQVNEKIEESLAFIRKSDELLWNWF-NH2 | 1001 |
| 1171 | Ac-YTSLIHSLIEESQNQQEKNEQELLELDKYASLYNYF-NH2 | 1002 |
| 1172 | Ac-YTSLIHSLIEESQNQQEKNEQELLELDKYAYLYNYF-NH2 | 1003 |
| 1173 | 2-Naphthoyl-AcaAcaAcaDEFDESISQVNEKIEESLAFIRKSDELLAcaAcaAcaW-NH2 | 1931 |
| 1174 | 2-Naphthoyl-AcaAcaAcaGDEFDESISQVNEKIEESLAFIRKSDELLGAcaAcaAcaW-NH2 | 1932 |
| 1175 | 2-Naphthoyl-GDEFDESISQVNEKIEESLAFIRESDELL-NH2 | 1006 |
| 1176 | 2-Naphthoyl-GDEFDESISQVNEKIEESLAFIEESDELL-NH2 | 1007 |
| 1177 | Ac-WQEWEQKVNYLEANITALLEQAQIQQEKNEYELQKL-NH2 | 1008 |
| 1178 | Ac-WQEWEQKVDYLEANITALLEQAQIQQEKNEYELQKL-NH2 | 1009 |
| 1179 | Ac-WQEWEQKVRWLEANITALLEQAQIQQEKNEYELQKL-NH2 | 1010 |
| 1180 | Ac-WQEWEKQVRYLEANITALLEQAQIQQEKNEYELQKL-NH2 | 1011 |
| 1181 | Ac-WQEWEHQVRYLEANITALLEQAQIQQEKNEYELQKL-NH2 | 1012 |
| 1182 | Ac-WQEWEHKVRYLEANITALLEQAQIQQEKNEYELQKL-NH2 | 1013 |
| 1183 | Ac-WQEWDREVRYLEANITALLEQAQIQQEKNEYELQKL-NH2 | 1014 |
| 1184 | Ac-WQEWEREVRYLEAMTALLEQAQIQQEKNEYELQKL-NH2 | 1015 |
| 1185 | Ac-WQEWERQVRYLEANITALLEQAQIQQEKNEYELQKL-NH2 | 1016 |
| 1186 | Ac-WQEWEQKVKYLEANITALLEQAQIQQEKNEYELQKL-NH2 | 1017 |
| 1187 | Ac-WQEWEQKVRFLEANITALLEQAQIQQEKNEYELQKL-NH2 | 1018 |
| 1188 | Ac-VNaIPSDEYDASISQVNEEINQALAYIRKADELLENV-NH2 | 1933 |
| 1189 | Ac-VNaIPSDENaIDASISQVNEEINQALAYIRKADELLENV-NH2 | 1934 |
| 1190 | Ac-VNalSDEYDASISQVNEEINQALANalIRKADELLENV-NH2 | 1935 |

TABLE V-continued

| T No. | Sequence | Seq. ID No. |
|---|---|---|
| 1191 | Ac-VYPSDEFDASISQVNEKINQSLAFIREADELLFNFF-NH2 | 1022 |
| 1192 | Ac-VYPSDEYDASISQVNEEINQALAYIRKADELLFNFF-NH2 | 1023 |
| 1193 | Ac-YTSLITALLEQAQIQQEKNEYELQKLDKWASLWNWF-NH2 | 1024 |
| 1194 | Ac-YTSLITALLEQAQIQQEKNEYELQKLDKWASLWEWF-NH2 | 1936 |
| 1195 | Ac-YTSLITALLEQAQIQQEKNEYELQKLDEWASLWEWF-NH2 | 1026 |
| 1196 | Ac-YTSLITALLEQAQIQQEKNEYELQELDEWASLWEWF-NH2 | 1027 |
| 1197 | Ac-YTSLITALLEEAQIQQEKNEYELQELDEWASLWEWF-NH2 | 1028 |
| 1198 | Naphthoyl-Aua-Aua-Aua-TALLEQAQIQQEKNEYELQKLAua-Aua-Aua-W-NH2 | 1937 |
| 1199 | Ac-WAAWEQKVRYLEANITALLEQAQIQQEKNEYELQKL-NH2 | 1030 |
| 1200 | Ac-WQEAAQKVRYLEANITALLEQAQIQQEKNEYELQKL-NH2 | 1031 |
| 1201 | Ac-WQEWAAKVRYLEANITALLEQAQIQQEKNEYELQKL-NH2 | 1032 |
| 1202 | Ac-WQAAEQKVRYLEANITALLEQAQIQQEKNEYELQKL-NH2 | 1938 |
| 1203 | Ac-WQEWEAAVRYLEANITALLEQAQIQQEKNEYELQKL-NH2 | 1939 |
| 1204 | Ac-WQEWEQAARYLEANITALLEQAQIQQEKNEYELQKL-NH2 | 1940 |
| 1205 | Ac-WQEWEQKAAYLEANITALLEQAQIQQEKNEYELQKL-NH2 | 1941 |
| 1206 | Ac-WQEWEQKVAALEANITALLEQAQIQQEKNEYELQKL-NH2 | 1942 |
| 1207 | Ac-WQEWEQKVRYLEANITALLEQAQIQQEKNEYELQKLGGGGWASLWNF-NH2 | 1943 |
| 1208 | 2-Naphthoyl-GDEFDASISQVNEKINQSLAFIRKSDELT-NH2 | 1039 |
| 1209 | 2-Naphthoyl-GDEFDASISQVNEKINQSLAFTRKSDELT-NH2 | 1040 |
| 1210 | 2-Naphthoyl-GDEFDASISQVNEKTNQSLAFTRKSDELT-NH2 | 1037 |
| 1211 | 2-Naphthoyl-GDEFDASISQTNEKTNQSLAFTRKSDELT-NH2 | 1038 |
| 1212 | 2-Naphthoyl-GDEFDASTSQTNEKTNQSLAFTRKSDELT-NH2 | 1039 |
| 1213 | 2-Naphthoyl-GDEYDASTSQTNEKTNQSLAFTRKSDELT-NH2 | 1040 |
| 1214 | 2-Naphthoyl-GDEFDEEISQVNEKIEESLAFIRKSDELL-NH2 | 1041 |
| 1215 | 2-Naphthoyl-GDEFDASISQVNEKINQSLAFIRKSDELA-NH2 | 1042 |
| 1216 | 2-Naphthoyl-GDEFDASASQANEKANQSLAFARKSDELA-NH2 | 1043 |
| 1217 | 2-Naphthoyl-GDEFDESISQVNEKIEESLAFTRKSDELL-NH2 | 1044 |
| 1218 | 2-Naphthoyl-GDEFDESISQVNEKTEESLAFIRKSDELL-NH2 | 1045 |
| 1219 | 2-Naphthoyl-GDEFDESISQTNEKIEESLAFIRKSDELL-NH2 | 1046 |
| 1220 | 2-Naphthoyl-GDEFDESTSQVNEKIEESLAFIRKSDELL-NH2 | 1047 |
| 1221 | Ac-WNWFDEFDESTSQVNEKIEESLAFIRKSDELLWNWF-NH2 | 1048 |
| 1222 | Ac-WNWFDEFDESTSQTNEKIEESLAFIRKSDELLWNWF-NH2 | 1049 |
| 1223 | Ac-WNWFDEFDESTSQTNEKTEESLAFIRKSDELLWNWF-NH2 | 1050 |
| 1224 | Ac-LQAGFFLLTRILTIPQSLDSWWTSLNFLGGTTVAL-NH2 | 1355 |
| 1225 | Ac-YTNLIYTLLEESQNQQEKNEQELLELDKWASLWSWF-NH2 | 1051 |
| 1226 | Ac-WQEWEQKVRYLEANITALLEQAQIQQEKNEYELQKLDKWASLWNWF-NH2 | 1052 |
| 1227 | Ac-NNMTWQEWEQKVRYLEANITALLEQAQIQQEKNEYELQKLDKWASLWNWF-NH2 | 1053 |
| 1230 | Ac-WNWFIEESDELLWNWF-NH2 | 1054 |
| 1231 | 2-Naphthoyl-GFIEESDELLW-NH2 | 1055 |
| 1232 | Ac-WFIEESDELLW-NH2 | 1056 |
| 1233 | 2-Naphthoyl-GFNFFIEESDELLFNFF-NH2 | 1057 |
| 1234 | 2-Naphthoyl-GESDELW-NH2 | 1058 |
| 1235 | Ac-WNWFGDEFDESISQVQEEIEESLAFIEESDELLGGWWWF-NH2 | 1059 |
| 1236 | Ac-WNWFIHSLIEESQNQQEKNEQELLELDKWASLWNWF-NH2 | 1356 |
| 1237 | Ac-YTSLITALLEQAQIQQEENEYELQALDEWASLWEWF-NH2 | 1025 |
| 1238 | Ac-YTSLIHSLGGDEFDESISQVNEEIEESLAFIEESDELLGGWASLWNWF-NH2 | 1060 |
| 1239 | 2-Naphthoyl-GDEFDESISQVQEEIEESLAFIEESDELL-NH2 | 1061 |
| 1240 | H-QARQLLSSIMQQQNNLLRAIEAQQHLLQLTVWGIKQLQARILAVERYLKDQ-OH | 1062 |
| 1241 | Ac-CPKYVKQNTLKLATGMRNVPEKQTR-NH2 | 1063 |
| 1242 | Ac-GLFGAIAGFIENGWEGMIDGWYGFRHQNSC-NH2 | 1064 |
| 1243 | Ac-LNFLGGT-NH2 | 1065 |
| 1244 | Ac-LDSWWTSLNFLGGT-NH2 | 1066 |
| 1245 | Ac-ILTIPQSLDSWWTSLNFLGGT-NH2 | 1067 |
| 1246 | Ac-GFFLLTRILTIPQSLDSWWTSLNFLGGT-NH2 | 1068 |
| 1247 | Ac-WQEWEQKITALLEQAQIQQEKNEYELQKLDKWASLWNWF-NH2 | 1069 |
| 1248 | Ac-WNWFITALLEQAQIQQEKNEYELQKLDKWASLWNWF-NH2 | 1070 |
| 1249 | Ac-WQEWEQKITALLEQAQIQQEKNEYELQKLDKWASLWEWF-NH2 | 1071 |
| 1250 | Ac-WQEWEQKVRYLEANITALLEQAQIQQEKIEYELQKL-NH2 | 1072 |
| 1251 | Ac-WQEWEQKVRYLEAQITALLEQAQIQQEKIEYELQKL-NH2 | 1073 |
| 1252 | Ac-KENKANGTDAKVKLIKQELDKYKNAVTELQLLMQS-NH2 | 1074 |
| 1253 | Ac-NIKENKANGTDAKVKLIKQELDKYKNAVTELQLLM-NH2 | 1075 |
| 1254 | (FS)-YTSLIHSLIEESQNQQEKNEQELLELDKWASLWNWF-NH2 | 1076 |
| 1255 | 2-Naphthoyl-GWNWFAcaDEFDESISQVQEEIEESLAFIEESDELLAcaWNWF-NH2 | 1944 |
| 1256 | Ac-WNWFGDEFDESISQVNEKIEESLAFIEESDELLGWNWF-NH2 | 1078 |
| 1257 | Ac-WNWFGDEFDESISQVNEKIEESLAFIRKSDELLGWNWF-NH2 | 1079 |
| 1258 | Ac-WNWF-Aca-DEFDESISQVNEKIEESLAFIRKSDELL-Aca-WNWF-NH2 | 1945 |
| 1259 | Ac-WNWF-Aca-DEFDESISQVNEKIEESLAFIEESDELL-Aca-WNWF-NH2 | 1946 |
| 1260 | Ac-EESQNQQEKNEQELLELDKWA-NH2 | 1082 |
| 1261 | EESQNQQEKNEQELLELDKWA | 1083 |
| 1262 | Ac-CGTTDRSGAPTYSWGANDTDVFVLNNTRPPLGNWFG-NH2 | 1084 |
| 1263 | Ac-GVEHRLEAACNWTRGERADLEDRDRSELSP-NH2 | 1085 |
| 1264 | Ac-CVREGNASRAWVAVTPTVATRDGKLPT-NH2 | 1086 |
| 1265 | Ac-CFSPRHHWTTQDANASIYPG-NH2 | 1087 |
| 1266 | Ac-LQHYREVAAAKSSENDRLRLLLKQMCPSLDVDS-NH2 | 1088 |
| 1267 | Ac-WQEWDREISNYTSLITALLEQAQIQQEKNEYELQKLDEWASLWEWF-NH2 | 1089 |
| 1268 | Ac-CWQEWDREISNYTSLITALLEQAQIQQEKNEYELQKLDEWASLWEWFC-NH2 | 1090 |

TABLE V-continued

| T No. | Sequence | Seq. ID No. |
|---|---|---|
| 1269 | Ac-WQEWDREISNYTSLITALLEQAQIQQEKNEYELQKLDEWEWF-NH2 | 1091 |
| 1270 | Ac-CWQEWDREISNYTSLITALLEQAQIQQEKNEYELQKLDEWEWFC-NH2 | 1092 |
| 1271 | Ac-GQNSQSPTSNHSPTSAPPTAPGYRWA-NH2 | 1093 |
| 1272 | Ac-PGSSTTSTGPARTALTTAQGTSLYPSA-NH2 | 1094 |
| 1273 | Ac-PGSSTTSTGPARTALTTAQGTSLYPSAAATKPSDGNATA-NH2 | 1095 |
| 1275 | Ac-WQEWDREITALLEQAQIQQEKNEYELQKLDKWASLWNWF-NH2 | 1097 |
| 1276 | Ac-WQEWDREITALLEQAQIQQEKNEYELQKLDEWASLWEWF-NH2 | 1098 |
| 1277 | Ac-WQEWDREITALLEQAQIQQEKNEYELQKLDEWEWF-NH2 | 1099 |
| 1278 | Ac-WQEWDREITALLEQAQIQQEKNEYELQKLDEWEWF-NH2 | 1947 |
| 1279 | Ac-WQEWEREITALLEQAQIQQEKNEYELQKLIEWEWF-NH2 | 1101 |
| 1280 | Ac-WQEWEREITALLEQAQIQQEKIEYELQKLDEWEWF-NH2 | 1102 |
| 1281 | Ac-WQEWEITALLEQAQIQQEKNEYELQKLDEWEWF-NH2 | 1103 |
| 1282 | Ac-WQEWEITALLEQAQIQQEKNEYELQKLIEWEWF-NH2 | 1104 |
| 1283 | Ac-WQEWEITALLEQAQIQQEKIEYELQKLDEWEWF-NH2 | 1105 |
| 1284 | Ac-WQEWEITALLEQAQIQQEKIEYELQKLIEWEWF-NH2 | 1106 |
| 1285 | Ac-WQEWDREIDEYDASISQVNEKINQALAYIREADELWEWF-NH2 | 1107 |
| 1286 | Ac-WQEWEREIDEYDASISQVNEKINQALAYIREADELWEWF-NH2 | 1108 |
| 1287 | Ac-WQEWEIDEYDASISQVNEKINQALAYIREADELWEWF-NH2 | 1109 |
| 1288 | Ac-WQEWDREIDEYDASISQVNEEINQALAYIREADELWEWF-NH2 | 1110 |
| 1289 | Ac-WQEWEREIDEYDASISQVNEEINQALAYIREADELWEWF-NH2 | 1111 |
| 1290 | Ac-WQEWEIDEYDASISQVNEEINQALAYIREADELWEWF-NH2 | 1112 |
| 1291 | Ac-WQEWDEYDASISQVNEKINQALAYIREADELWEWF-NH2 | 1113 |
| 1292 | Ac-WQEWDEYDASISQVNEEINQALAYIREADELWEWF-NH2 | 1114 |
| 1293 | Ac-WQEWEQKITALLEQAQIQQEKIEYELQKLIEWEWF-NH2 | 1115 |
| 1294 | Ac-WQEWEQKITALLEQAQIQQEKIEYELQKLIEWASLWEWF-NH2 | 1116 |
| 1295 | Ac-WQEWEITALLEQAQIQQEKIEYELQKLIEWASLWEWF-NH2 | 1117 |
| 1298 | -VYPSDEYDASISQVNEEWQALAYIRKADELLENV-NH2 | 1160 |
| 1299 | Ac-WVYPSDEYDASISQVNEEINQALAYIRKADELLENVWNWF-NH2 | 1120 |
| 1300 | YTSLIRSLIEESQNQQEKNEQELLELDKWASLWNWF-NH2 | 1121 |
| 1301 | Ac-WQEWDEYDASISQVNEKINQALAYIREADELWAWF-NH2 | 1122 |
| 1302 | Ac-WQAWDEYDASISQVNEKWQALAYIREADELWAWF-NH2 | 1123 |
| 1303 | Ac-WQAWDEYDASISQVNEKWQALAYIREADELWEWF-NH2 | 1124 |
| 1304 | Biotin-YDPLVFPSDEFDASISQVNEKWQSLAFIRKSDEL-NH2 | 1125 |
| 1305 | Biotin-YDPLVFPSDEFDASISQVNEKWQSLAF-NH2 | 1126 |
| 1306 | Biotin-QVNEKWQSLAFIRKSDELLHNVAGKST-NH2 | 1127 |
| 1307 | Ac-WMEWDREI-NH2 | 1128 |
| 1308 | Ac-WQEWEQKI-NH2 | 1129 |
| 1309 | Ac-WQEWEQKITALLEQAQIQQEKIEYELQKLIKWASLWEWF-NH2 | 1130 |
| 1310 | Ac-WQEWEQKITALLEQAQIQQEKIEYELQKLIEWASLWEWF-NH2 | 1131 |
| 1311 | Ac-WQEWEREISAYTSLITALLEQAQIQQEKIEYELQKLIEWEWF-NH2 | 1132 |
| 1312 | Ac-WQEWEREISAYTSLITALLEQAQIQQEKIEYELQKEWEWF-NH2 | 1133 |
| 1313 | Ac-WQEWEREISAYTSLITALLEQAQIQQEKIEYELQKEWEW-NH2 | 1134 |
| 1314 | Ac-WQEWEREISAYTSLITALLEQAQIQQEKIEYELQKLIEWEW-NH2 | 1135 |
| 1315 | Ac-FNLSDHSESIQKKFQLMKKHVNKIGVDSDPIGSWLR-NH2 | 1136 |
| 1316 | Ac-DHSESIQKKFQLMKKHVNKIGVDSDPIGSWLRGIF-NH2 | 1137 |
| 1317 | Ac-WSVKQANLTTSLLGDLLDDVTSIRHAVLQNRA-NH2 | 1138 |
| 1318 | Biotin-WMEWDREI-NH2 | 1128 |
| 1319 | Biotin-NNMTWMEWDREWNYTSL-NH2 | 1139 |
| 1320 | Ac-GAASLTLTVQARQLLSGIVQQQNNLLRAIEAQQHLL-NH2 | 1140 |
| 1321 | Ac-ASLTLTVQARQLLSGIVQQQNNLLRAIEAQQRLLQL-NH2 | 1141 |
| 1322 | Ac-VSVGNTLYYVNKQEGKSLYVKGEPIWFYDPLVF-NH2 | 1142 |
| 1323 | Ac-QHWSYGLRPG-NH2 | 1143 |
| 1324 | Ac-WQEWEQKIQHWSYGLRPGWASLWEWF-NH2 | 1144 |
| 1325 | Ac-WQEWEQKIQHWSYGLRPGWEWF-NH2 | 1145 |
| 1326 | Ac-WNWFQHWSYGLRPGWNWF-NH2 | 1146 |
| 1327 | Ac-FNFFQHWSYGLRPGFNFF-NH2 | 1147 |
| 1328 | Ac-GAGAQHWSYGLRPGAGAG-NH2 | 1148 |
| 1329 | PLLVLQAGFFLLTRILTIPQSLDSWWTSLNFLGGT | 482 |
| 1330 | Ac-WQEWEQKITALLEQAQIQQEKIEYELQKLAKWASLWEWF-NH2 | 1149 |
| 1331 | Ac-WQEWEQKITALLEQAQIQQEKIEYELQKLAEWASLWEWF-NH2 | 1150 |
| 1332 | Ac-WQEWEQKITALLEQAQIQQEKAEYELQKLAEWASLWEWF-NH2 | 1151 |
| 1333 | Ac-WQEWEQKITALLEQAQIQQEKAEYELQKLAEWASLWAWF-NH2 | 1152 |
| 1334 | Ac-WQEWEQKITALLEQAQIQQEKAEYELQKLAKWASLWAWF-NH2 | 1153 |
| 1335 | Ac-TKKAVVSLSNGVSVLTSKVLDLKNYIDKQLLPIVNK-NH2 | 1154 |
| 1336 | Ac-KAVVSLSNGVSVLTSKVLDLKNYIDKQLLPIVNKQS-NH2 | 1155 |
| 1337 | Ac-WQEWEQKITALLEQAQIQQEKNEYELQKLIEWEWF-NH2 | 1156 |
| 1338 | Ac-WQEWEQKITALLEQAQIQQEKNEYELQKLIEWEWF-NH2 | 1948 |
| 1339 | Ac-WQEWEQKITALLEQAQIQQEKIEYELQKLDKWEWF-NH2 | 1158 |
| 1340 | Ac-YDPLVFPSDEFDASISQVNEKWQSLAF-NH2 | 1159 |
| 1341 | Fluor--VYPSDEYDASISQVNEEINQALAYIRKADELLENV-NH2 | 1160 |
| 1342 | Fluor-YTSLIHSLIEESQNQQEKNEQELLELDKWASLWNWF-NH2 | 1161 |
| 1344 | Ac-SGIVQQQNNLLRAIEAQQHLLQLTVWGIKQLQARIL-NH2 | 1162 |
| 1345 | Ac-QQQNNLLRAIEAQQHLLQLTVWGIKQLQARILAVERYLKDQ-NH2 | 1163 |
| 1346 | Ac-SGIVQQQNNLLRAIEAQQHLLQLTVWGIKQLQARILAVERYLKDQ-NH2 | 1164 |
| 1347 | Ac-WQEWEQKITALLEQAQIQQEKNEYELQKLAEWASLWAWF-NH2 | 1165 |
| 1348 | Ac-WQEWEQKITALLEQAQIQQEKNEYELQKLAEWASLWAW-NH2 | 1166 |

TABLE V-continued

| T No. | Sequence | Seq. ID No. |
|---|---|---|
| 1349 | Ac-WQEWEQKITALLEQAQIQQEKAEYELQKLAEWASLWAW-NH2 | 1167 |
| 1350 | Ac-WQEWEQKITALLEQAQIQQEKNEYELQKLAEWAGLWAWF-NH2 | 1168 |
| 1351 | Ac-WQEWEQKITALLEQAQIQQEKNEYELQKLAEWAGLWAW-NH2 | 1169 |
| 1352 | Ac-WQEWEQKITALLEQAQIQQEKAEYELQKLAEWAGLWAW-NH2 | 1170 |
| 1353 | Ac-WQEWEQKITALLEQAQIQQEKNEYELQKLDKWAGLWEWF-NH2 | 1171 |
| 1354 | Ac-WQEWQHWSYGLRPGWEWF-NH2 | 1172 |
| 1355 | Ac-WQAWQHWSYGLRPGWAWF-NH2 | 1173 |
| 1356 | Biotinyl-WQEWEQKITALLEQAQIQQEKNEYELQKLDKWASLWEWF-NH2 | 1174 |
| 1357 | WQEWEQKITALLEQAQIQQEKNEYELQKLDKWASLWEWF | 1175 |
| 1358 | WQEWEQKITALLEQAQIQQEKIEYELQKLIEWEWF | 1176 |
| 1361 | Ac-AGSTMGARSMTLTVQARQLLSGIVQQQNNLLRAIEAQQ-NH2 | 1179 |
| 1362 | Ac-AGSAMGAASLTLSAQSRTLLAGIVQQQQQLLDVVKRQQ-NH2 | 1180 |
| 1363 | Ac-AGSAMGAASTALTAQSRTLLAGIVQQQQQLLDVVKRQQ-NH2 | 1181 |
| 1364 | Ac-ALTAQSRTLLAGIVQQQQQLLDVVKRQQELLRLTVWGT-NH2 | 1182 |
| 1365 | Ac-TLSAQSRTLLAGIVQQQQQLLDVVKRQQEMLRLTVWGT-NH2 | 1183 |
| 1366 | Ac-TLTVQARQLLSGIVQQQNNLLRAIEAQQHLLQLTVWGI-NH2 | 1184 |
| 1367 | Ac-WQAWIEYEAELSQVKEKIEQSLAYIREADELWAWF-NH2 | 1185 |
| 1368 | Ac-WQAWIEYEASLSQAKEKIEESKAYIREADELWAWF-NH2 | 1186 |
| 1369 | Ac-WQAWIEYERLLVQAKLKIAIAKLYLAKELLEWAWF-NH2 | 1187 |
| 1370 | Ac-WQAWIEYERLLVQVKLKIALALLYIAKELLEWAWF-NH2 | 1188 |
| 1371 | Ac-WQAWIELERLLVQVKLKLAIAKLELAKELLEWAWF-NH2 | 1189 |
| 1372 | Ac-GEWTYDDATKTFTVTEGGH-NH2 | 1190 |
| 1373 | Ac-WQEWEQKIGEWTYDDATKTFTVTEGGHWASLWEWF-NH2 | 1191 |
| 1374 | Ac-GEWTYDDATKTFTVTE-NH2 | 1192 |
| 1375 | Ac-WQEWEQKIGEWTYDDATKTFTVTEWASLWEWF-NH2 | 1193 |
| 1376 | Ac-MHRFDYRT-NH2 | 1194 |
| 1377 | Ac-WQEWEQKIMHRFDYRTWASLWEWF-NH2 | 1195 |
| 1378 | Ac-MHRFNWSTGGG-NH2 | 1196 |
| 1379 | Ac-WQEWEQKIMHRFNWSTGGGWASLWEWF-NH2 | 1197 |
| 1380 | Ac-MHRFNWST-NH2 | 1198 |
| 1381 | Ac-WQEWEQKIMHRFNWSTWASLWEWF-NH2 | 1199 |
| 1382 | Ac-LLVPLARIMTMSSVHGGG-NH2 | 1200 |
| 1383 | Ac-WQEWEQKILLVPLARIMTMSSVHGGGWASLWEWF-NH2 | 1201 |
| 1384 | Ac-LLVPLARIMTMSSVH-NH2 | 1202 |
| 1385 | Ac-WQEWEQKILLVPLARIMTMSSVHWASLWEWF-NH2 | 1203 |
| 1386 | TALLEQAQIQQEKNEYELQKLDK | 1204 |
| 1387 | Ac-TALLEQAQIQQEKNEYELQKLDK-NH2 | 1205 |
| 1388 | Ac-TALLEQAQIQQEKIEYELQKLIE-NH2 | 1206 |
| 1389 | TALLEQAQIQQEKIEYELQKLIE | 1207 |
| 1390 | Ac-QARQLLSGIVQQQNNLLRAIEAQQHLLQLTVWGIKQLQARILAVERY-NH2 | 1208 |
| 1391 | Rhod-QARQLLSGIVQQQNNLLRAIEAQQHLLQLTVWGIKQLQARILAVERY-NH2 | 1209 |
| 1392 | Ac-GAASLTLSAQSRTLLAGIVQQQQQLLDVVKRQQEML-NH2 | 1210 |
| 1393 | Ac-GSAMGAASLTLSAQSRTLLAGIVQQQQQLLDVVKRQQEML-NH2 | 1211 |
| 1394 | Ac-PALSTGLIHLHQNIVDVQFLFGVGSSIASWAIKWEY-NH2 | 1212 |
| 1395 | Ac-PALSTGLIHLHQNIVDVQFLYGVGSSIASWAIK-NH2 | 1213 |
| 1396 | Ac-LSTTQWQVLPUSFTTLPALSTGLIHLHQNIVDVQY-NH2 | 1949 |
| 1397 | Ac-FRKFPEATFSRUGSGPRITPRLMVDFPFRLWHY-NH2 | 1950 |
| 1398 | Ac-DFPFRLWIIFPUTINYTIFKVRLFVGGVEHRLEAAUNWTR-NH2∅ | 1951 |
| 1399 | Ac-YVGGVEHRLEAAUNWTRGERUDLEDRDRSELSPL-NH2 | 1952 |
| 1400 | MVYPSDEYDASISQVNEEINQALAYIRKADELLENV | 1218 |
| 1402 | Ac-GPLLVLQAGFFLLTRILTIPQSLDSWWTSLNFLGG-NH2 | 1220 |
| 1403 | Ac-LGPLLVLQAGFFLLTRILTIPQSLDSWWTSLNFLG-NH2 | 1221 |
| 1404 | Ac-FLGPLLVLQAGFFLLTRILTIPQSLDSWWTSLNFL-NH2 | 1222 |
| 1405 | Ac-YTNTIYTLLEESQNQQEKNEQELLELDKWASLWNWF-NH2 | 1357 |
| 1406 | YTNTIYTLLEESQNQQEKNEQELLELDKWASLWNWF | 1357 |
| 1407 | Ac-YTGIIYNLLEESQNQQEKNEQELLELDKWANLWNWF-NH2 | 1358 |
| 1408 | YTGIIYNLLEESQNQQEKNEQELLELDKWANLWNWF | 1359 |
| 1409 | Ac-YTSLIYSLLEKSQIQQEKNEQELLELDKWASLWNWF-NH2 | 1360 |
| 1410 | YTSLIYSLLEKSQIQQEKNEQELLELDKWASLWNWF | 1360 |
| 1411 | Ac-EKSQIQQEKNEQELLELDKWA-NH2 | 1362 |
| 1412 | EKSQIQQEKNEQELLELDKWA | 1362 |
| 1413 | Ac-EQAQIQQEKNEYELQKLDKWA-NH2 | 1364 |
| 1414 | Ac-YTSLIGSLIEESQIQQERNEQELLELDRWASLWEWF-NH2 | 1223 |
| 1415 | Ac-YTXLIHSLIXESQNQQXKNEQELXELDKWASLWNWF-NH2 | 1366 |
| 1416 | Ac-YTXLIHSLIWESQNQQXKNEQELXELD-NH2 | 1953 |
| 1417 | Ac-YTSLIHSLIEESQNQQEKNEQELLELD-NH2 | 1368 |
| 1418 | Ac-WQEQEXKITALLXQAQIQQXKNEYELXKLDKWASLWEWF-NH2 | 1954 |
| 1419 | Ac-XKITALLXQAQIQQXKNEYELXKLDKWASLWEWF-NH2 | 1370 |
| 1420 | Ac-WQEWWXKITALLXQAQIQQXKNEYELXKLD-NH2 | 1955 |
| 1421 | Ac-WEQKITALLEQAQIQQEKNEYELQKLD-NH2 | 1372 |
| 1422 | Ac-WEXKITALLXQAQIQQXKNEYELXKLD-NH2 | 1956 |
| 1423 | Ac-XKITALLXQAQIQQXKNEYELXKLD-NH2 | 1374 |
| 1425 | Ac-QKITALLEQAQIQQEKNEYELQKLD-NH2 | 1375 |
| 1426 | Ac-QKITALLEQAQIQQEKNEYELQKLDKWASLWEWF-NH2 | 1381 |
| 1427 | Ac-WQEWEQKITALLEQAQIQQEKNEYELQKLD-NH2 | 1379 |
| 1428 | Ac-VYPSDEYDASISQVNEEINQALAYIRKADELLEN-OH | 1237 |

TABLE V-continued

| T No. | Sequence | Seq. ID No. |
|---|---|---|
| 1429 | Ac-VYPSDEYDASISQVNEEINQALAYIRKADELLE-OH | 1237 |
| 1430 | Ac-VYPSDEYDASISQVNEEINQALAYIRKADELL-OH | 1376 |
| 1431 | Ac-VYPSDEYDASISQVNEEINQALAYIRKADEL-OH | 1378 |
| 1432 | YPSDEYDASISQVNEEINQALAYIRKADELLENV-NH2 | 1227 |
| 1433 | PSDEYDASISQVNEEINQALAYIRKADELLENV-NH2 | 1228 |
| 1434 | SDEYDASISQVNEEINQALAYIRKADELLENV-NH2 | 1229 |
| 1435 | DEYDASISQVNEEINQALAYIRKADELLENV-NH2 | 1230 |
| 1436 | Ac-VYPSDEYDASISQVDEEINQALAYIRKADELLENV-NH2 | 1231 |
| 1437 | Ac-VYPSDEYDASISQVNEEIDQALAYIRKADELLENV-NH2 | 1232 |
| 1438 | Ac-VYPSDEYDASISQVNEEINQALAYIRKADELLEDV-NH2 | 1233 |
| 1439 | Ac-VYPSDEYDASISQVDEEIDQALAYIRKADELLENV-NH2 | 1234 |
| 1440 | Ac-LLSTNKAVVSLSNGVSVLTSKVLDLKNYIDKQLLP-NH2 | 1235 |
| 1441 | Ac-LSTNKAVVSLSNGVSVLTSKVLDLKNYIDKQLLPI-NH2 | 1236 |
| 1442 | Ac-STNKAVVSLSNGVSVGTSKVLDLKNYIDKQLLPIV-NH2 | 1957 |
| 1443 | Ac-TNKAVVSLSNGVSVLTSKVLDLKNYIDKQLLPIVN-NH2 | 1383 |
| 1444 | Ac-NKAVVSLSNGVSVLTSKVLDLKNYIDKQLLPIVNK-NH2 | 1384 |
| 1445 | Ac-KAVVSLSNGVSVLTSKVLDLKNYIDKQLLPIVNKQ-NH2 | 1385 |
| 1446 | Ac-AVVSLSNGVSVLTSKVLDLKNYIDKQLLPIVNKQS-NH2 | 1155 |
| 1447 | Ac-VVSLSNGVSVLTSKVLDLKNYIDKQWLLPIVNKQSU-NH2 | 1958 |
| 1448 | Ac-VSLSNGVSVLTSKVLDLKNYIDKQLLPIVNKQSUS-NH2 | 1959 |
| 1449 | Ac-SLSNGVSVLTSKVLDLKNYIDKQLLPIVNKQSUSI-NH2 | 1960 |
| 1450 | Ac-LSNGVSVLTSKVLDKLKNYIDKQLLPIVNKQSUSIS-NH2 | 1961 |
| 1451 | Ac-SNGVSVLTSKVLDLKNYIDKQLLPIVNKQSUSISN-NH2 | 1962 |
| 1452 | Ac-NGVSVLTSKVLDLKNYIDKQLLPIVNKQSUSISNI-NH2 | 1963 |
| 1453 | Ac-GVSVLTSKVLDLKNYIDKQLLPIVNKQSUSISNIE-NH2 | 1964 |
| 1454 | Ac-VSVLTSKVLDLKNYIDKQLLPIVNKQSUSISINIET-NH2 | 1965 |
| 1455 | Ac-SVLTSKVLDLKNYIDKQLLPIVNKQSUSISNIETV-NH2 | 1966 |
| 1456 | Ac-VLTSKVLDLKNYIDKQLLPIVNKQSUSISNIETVI-NH2 | 1967 |
| 1457 | Ac-LTSKVLDLKNYIDKQLLPIVNKQSUSISNIETVIE-NH2 | 1968 |
| 1458 | Ac-TSKVLDLKNYIDKQLLPIVKQSUSISNIETVIEF-NH2 | 1969 |
| 1459 | Ac-SKVLDLKNYIDKQLLPIVNKQSUSISNIETVIEFQ-NH2 | 1970 |
| 1460 | Ac-KVLDLKNYIDKQLLPIVNKQSUSISNIETVIEFQQ-NH2 | 1971 |
| 1461 | Ac-VLDLKNYIDKQLLPIVNKQSUSISMETVIEFQQK-NH2 | 1972 |
| 1462 | Ac-LDLKNYIDKQLLPIVNKQSUSISNIETVIEFQQKN-NH2 | 1973 |
| 1463 | Ac-DLKNYIDKQLLPIVNKQSUSISNIETVIEFQQKNN-NH2 | 1974 |
| 1464 | Ac-LKNYIDKQLLPIVNKQSUSISNIETVIEFQQKNNR-NH2 | 1975 |
| 1465 | Ac-KNYIDKQLLPIVNKQSUSISNIETVIEFQQKNNRL-NH2 | 1976 |
| 1466 | Ac-NYIDKQLLPIVNKQSUSISNIETVIEFQQKNNRLL-NH2 | 1977 |
| 1467 | Ac-YIDKQLLPIVNKQSUSISMETVIEFQQKNNRLLE-NH2 | 1978 |
| 1468 | Ac-IDKQLLPIVNKQSUSISNIETVIEFQQKNNRLLEI-NH2 | 1979 |
| 1469 | Ac-DKQLLPIVNKQSUSISNIETVIEFQQKNNRLLEIT-NH2 | 1980 |
| 1470 | Ac-KQLLPIVNKQSUSISNIETVIEFQQKNNRLLEITR-NH2 | 1981 |
| 1471 | Ac-QLLPIVNKQSUSISNIETVIEFQQKNNRLLEITRE-NH2 | 1982 |
| 1472 | Ac-VYPSDEYDASISQVNEEINQALA | 1412 |
| 1473 | QVNEEINQALAYIRKADELLENV-NH2 | 1413 |
| 1474 | VYPSDEYDASISQVNEEINQALAYIRKADELLENV | 1414 |
| 1475 | Ac-DEYDASISQVNEEINQALAYIREADEL-NH2 | 1415 |
| 1476 | Ac-DEYDASISQVNEKINQALAYIREADEL-NH2 | 1416 |
| 1477 | Ac-DDECLNSVKNGTYDFPKFEEESKLNRNEIKGVKLS-NH2 | 1417 |
| 1478 | Ac-DDE-Abu-LNSVKNGTYDFPKFEEESKLNRNEIKGVKLS-NH2 | 1983 |
| 1479 | Ac-YHKCDDECLNSVKNGTFDFPKFEEESKLNRNEIKGVKLSS-NH2 | 1984 |
| 1480 | Ac-YHK-Abu-DDE-Abu-LNSVKNGTFDFPKFEEESKLNRNEIKGVKLSS-NH2 | 1985 |
| 1481 | Ac-YTSLIHSLIEESQIQQEKNEQELLELDKWASLWNWF-NH2 | 1986 |
| 1482 | Ac-YTSLIHSLIEESQNQQEKNEYELLELDKWASLWNWF-NH2 | 1987 |
| 1483 | Ac-YTSLIHSLIEESQIQQEKNEYELLELDKWASLWNWF-NH2 | 1988 |
| 1484 | Ac-YTSLIHSLIEESQIQQEKNEYELQKLDKWASLWNWF-NH2 | 1244 |
| 1485 | Ac-YTSLIHSLIEESQNQQEKNEQELQKLDKWASLWNWF-NH2 | 1245 |
| 1486 | Ac-YTSLIHSLIEESQNQQEKNEYELQKLDKWASLWNWF-NH2 | 1421 |
| 1487 | Ac-YTSLIHSLIEESQIQQEKNEQELQKLDKWASLWNWF-NH2 | 1422 |
| 1488 | Ac-YTSLIHSLIEESQNQQEKNEQELLELDKWASLWEWF-NH2 | 1423 |
| 1489 | Ac-YTSLIHSLIEESQIQQEKNEQELLBLDKWASLWEWF-NH2 | 1424 |
| 1490 | Ac-YTSLIHSLIEESQNQQEKNEYELLELDKWASLWEWF-NH2 | 1425 |
| 1491 | Ac-YTSLIHSLIEESQIQQEKNEYELLELDKWASLWEWF-NH2 | 1426 |
| 1492 | Ac-YTSLIHSLIEESQIQQEKNEYELQKLDKWASLWEWF-NH2 | 1989 |
| 1493 | Ac-YTSLIHSLIEESQNQQEKNBQELQKLDKWASLWEWF-NH2 | 1428 |
| 1494 | Ac-YTSLIHSLIEESQNQQEKNEYELQKLDKWASLWEWF-NH2 | 1429 |
| 1495 | Ac-YTSLIHSLIEESQIQQEKNEQELQKLDKWASLWEWF-NH2 | 1430 |
| 1496 | Ac-WQEQEQKITALLEQAQIQQEKNEYELQKLDKEWWF-NH2 | 1990 |
| 1497 | Ac-WQEWEQKITALLEQAQIQQEKNEYELQKLIEWASLWEWF-NH2 | 1432 |
| 1498 | Ac-WQEWEQKITALLEQAQIQQEKNEYELQKLAKWASLWEWF-NH2 | 1256 |
| 1499 | Ac-WQEWEQKITALLEQAQIQQEKNEYELQKLIKWASLWEWF-NH2 | 1257 |
| 1500 | Ac-WQEWEQKITALLEQAQIQQEKNEYELQKLIEWAGLWEWF-NH2 | 1258 |
| 1501 | Ac-WQEWEQKITALLEQAQIQQEKNEYELQKLAKWAGLWEWF-NH2 | 1260 |
| 1502 | Ac-WQEWEQKITALLEQAQIQQEKNEYELQKLIKWAGLWEWF-NH2 | 1259 |
| 1503 | Ac-WQEWEQKITALLEQAQIQQEKNEYELQKLIEWAGLWAWF-NH2 | 1261 |
| 1504 | Ac-WQEWEQKITALLEQAQIQQEKNEYELQKLAKWAGLWAWF-NH2 | 1262 |

TABLE V-continued

| T No. | Sequence | Seq. ID No. |
|---|---|---|
| 1505 | Ac-WQEWEQKITALLEQAQIQQEKNEYELQKLIKWAGLWAWF-NH2 | 1263 |
| 1506 | Ac-WQEWEQKITALLEQAQIQQEKGEYELQKLDKQEQF-NH2 | 1267 |
| 1507 | Ac-WQEWEQKITALLEQAQIQQEKGEYELLELDKWEWF-NH2 | 1265 |
| 1508 | Ac-WQEWEQKITALLEQAQIQQEKGEYELQKLAKWEWF-NH2 | 1266 |
| 1509 | Ac-WQEWEQKITALLEQAQIQQEKGEYELQKLDWQWEF-NH2 | 1991 |
| 1510 | Ac-WQEWEQKITALLEQAQIQQEKGEYELLELAKWEWF-NH2 | 1268 |
| 1511 | Ac-WEQWEQKITALLEQAQIQQEKNEYELLELDKWEWF-NH2 | 1992 |
| 1512 | Ac-WQEWEQKITALLEQAQIQQEKNEYELEEELIEWASLWEWF-NH2 | 1993 |
| 1513 | Ac-WQEWEQKITALLEQAQIQQEKNEYELLELIEWAGLWEWF-NH2 | 1271 |
| 1514 | Ac-WQEWEQKITALLEQAQIQQEKNEYELLELIEWAGLWAWF-NH2 | 1272 |
| 1515 | Ac-WQEWEREITALLEQAQIQQEKNEYELQKLIEWASLWEWF-NH2 | 1273 |
| 1516 | Ac-WQEWEREIQQEKNEYELQKLDKWASLWEWF-NH2 | 1274 |
| 1517 | Ac-WQEWEREIQQEKGEYELQKLIEWEWF-NH2 | 1275 |
| 1518 | Ac-WQEWQAQIQQEKNEYELQKLDKWASLWEWF-NH2 | 1994 |
| 1519 | Ac-WQEWQAQIQQEKGEYELQKLIEWEWF-NH2 | 1277 |
| 1520 | PEG-GWQEWEQRITALLEQAQIQQERNEYELQRLDEWASLWEWF-NH2 | 1439 |
| 1521 | Ac-GWQEWEQRITALLEQAQIQQERNEYELQRLDEWASLWEWF-NH2 | 1438 |
| 1522 | PEG-YTSLITALLEQAQIQQERNEQELLELDEWASLWEWF-NH2 | 1441 |
| 1523 | Ac-YTSLITALLEQAQIQQERNEQELLELDEWASLWEWF-NH2 | 1440 |
| 1526 | PEG-GWQEWEQRITALLEQAQIQQERNEYELQELDEWASLWEWF-NH2 | 1443 |
| 1527 | Ac-GWQEWEQRITALLEQAQIQQERNEYELQELDEWASLWEWF-NH2 | 1442 |
| 1528 | PEG-YTSLIGSLIEESQIQQERNEQELLELDRWASLWEWF-NH2 | 1444 |
| 1529 | PEG-GWQEWEQRITALLEQAQIQQERNEYELQRLDRWASLWEWF-NH2 | 1445 |
| 1530 | Ac-GWQEWEQRITALLEQAQIQQERNEYELQRLDRWASLWEWF-NH2 | 1445 |
| 1531 | PEG-GWQEWEQRITALLEQAQIQQERNEYELQELDRWASLWEWF-NH2 | 1447 |
| 1532 | Ac-GWQEWEQRITALLEQAQIQQERNEYELQELDRWASLWEWF-NH2 | 1447 |
| 1533 | PEG-YTSLIGSLIEESQNQQERNEQELLELDRWASLWNWF-NH2 | 1449 |
| 1534 | Ac-YTSLIGSLIEESQNQQERNEQELLELDRWASLWNWF-NH2 | 1449 |
| 1538 | Ac-YTSLIHSLIEESQNQQEK-OH | 225 |
| 1539 | NEQELLELDK | 631 |
| 1540 | WASLWNWF-NH2 | 222 |
| 1542 | Ac-AAAWEQKITALLEQAQIQQEKNEYELQKLDKWASLWEWF-NH2 | 1453 |
| 1543 | Ac-WQEAAAKITALLEQAQIQQEKNEYELQKLDKWASLWEWF-NH2 | 1454 |
| 1544 | Ac-WQEWEQAAAALLEQAQIQQEKNEYELQKLDKWASLWEWF-NH2 | 1455 |
| 1545 | Ac-WQEWEQKITAAAEQAQIQQEKNEYELQKLDKWASLWEWF-NH2 | 1456 |
| 1546 | Ac-WQEWEQKITALLAAAQIQQEKNEYELQKLDKWASLWEWF-NH2 | 1457 |
| 1547 | Ac-WQEWEQKITALLEQAAAAQEKNEYELQKLDKWASLWEWF-NH2 | 1458 |
| 1548 | Ac-WQEWEQKITALLEQAQIQAAANEYELQKLDKWASLWEWF-NH2 | 1459 |
| 1549 | Ac-WQEWEQKITALLEQAQIQQEKAAAELQKLDKWASLWEWF-NH2 | 1460 |
| 1550 | Ac-WQEWEQKITALLEQAQIQQEKNEYAAAKLDKWASLWEWF-NH2 | 1461 |
| 1551 | Ac-WQEWEQKITALLEQAQIQQEKNEYELQAAAKWASLWEWF-NH2 | 1462 |
| 1552 | Ac-WQEWEQKITALLEQAQIQQEKNEYELQKLDAAASLWEWF-NH | 1463 |
| 1553 | Ac-WQEWEQKITALLEQAQIQQEKNEYELQKLDKWAAAAEWF-NH | 1464 |
| 1554 | Ac-WQEWEQKITALLEQAQIQQEKNEYELQKLDKWASLWAAA-NH | 1465 |
| 1556 | Ac-YTSLIHSLIEESQNQQEKNEQELLLDKWASLWNWF-NH2 | 1466 |
| 1557 | Ac-YTSLIHSLIEESQNQQEKNEQELLELDKWASLWNWF-NH2 | 1467 |
| 1558 | Ac-ERTLDFHDS-NH2 | 1468 |
| 1559 | Ac-YTSLIHSLIEESQNQQEKNEQELLELDKWASLWN(W)F-NH2 | 1469 |
| 1563 | Ac-YTSLIHSLIEESQN(Q)QEKNEQELLELDKWASLWNWF-NH2 | 1470 |
| 1564 | Ac-YTSLIHSLIEESQNQQDKWASLWNWF-NH2 | 1471 |
| 1566 | Ac-FYEIIMDIEQNNVQGKKGIQQLQKWEDWVGWIGNI-NH2 | 1472 |
| 1567 | Ac-INQTIWNHGNITLGEWYNQTKDLQQKFYEIIMDIE-NH2 | 1473 |
| 1568 | Ac-WNHGNITLGEWYNQTKDLQQKFYEIIMDIEQNNVQ-NH2 | 1474 |
| 1572 | Ac-YTSLIHSLIEESENQQEKNEQELLELDKWASLWNWF-NH2 | 1475 |
| 1573 | Ac-YTSLIHSLIEESQDQQEKNEQELLELDKWASLWNWF-NH2 | 1476 |
| 1574 | Ac-YTSLIHSLIEESQNEQEKNEQELLELDKWASLWNWF-NH2 | 1477 |
| 1575 | c-YTSLIHSLIEESQNQEEKNEQELLELDKWASLWNWF-NH2 | 1478 |
| 1576 | Ac-YTSLIHSLIEESQNQQEKDEQELLELDKWASLWNWF-NH2 | 1479 |
| 1577 | Ac-LGEWYNQTKDLQQKFYEIIMDIEQNNVQGKKGIQQ-NH2 | 1480 |
| 1578 | Ac-WYNQTKDLQQKFYEIIMDIEQNNVQGKKGIQQLQK-NH2 | 1481 |
| 1579 | Ac-YTSLIHSLIEESQNQQEKNEEELLELDKWASLWNWF-NH2 | 1482 |
| 1580 | Ac-YTSLIHSLIEESQNQQEKNEQELLELDKWASLWDWF-NH2 | 1483 |
| 1586 | Ac-XTSLIHSLIEESQNQQEKNEQELLELDKWASLWNWX-NH2 | 1484 |
| 1588 | Ac-YNQTKDLQQKFYEIIMDIEQNNVQGKKGIQQLQKW-NH2 | 1485 |
| 1598 | Ac-YTSLIHSLIEESQNQQEKNEQELLELDKWASLWNWF | 1486 |
| 1600 | Ac-TLTVQARQLLSGIVQQQNNLLRAIEAQQHLLQLTVWGIKQLQAR-NH2 | 1487 |
| 1603 | Ac-LQQKFYEIIMDIEQNNVQGKKGIQQLQKWEDWVGW-NH2 | 1488 |
| 1627 | Ac-YTSLIHSLIEESQNQQEKNEQELLALDKWASLWNWF-NH2 | 1489 |
| 1628 | Ac-YTSLIHSLIEESQNQQEKNEQELLEADKWASLWNWF-NH2 | 1490 |
| 1629 | Ac-YTSLIHSLIEESQNQQEKNEQELLELAKWASLWNWF-NH2 | 1491 |
| 1630 | Ac-YTSLIHSLIEESQNQQEKAEQELLELDKWASLWNWF-NH2 | 1492 |
| 1631 | Ac-YTSLIHSLIEESQNQQEKNAQELLELDKWASLWNWF-NH2 | 1493 |
| 1632 | Ac-YTSLIHSLIEESQNQQEKNEAELLELDKWASLWNWF-NH2 | 1494 |
| 1634 | Ac-WQEWEQKITALLEQAQIQQEKNEQELQKLDKWASLWEWF-NH2 | 1495 |
| 1635 | Ac-WQEWEQKITALLEQAQIQQEKABYELQKLDKWASLWEWF-NH2 | 1496 |
| 1636 | Ac-WQEWEQKITALLEQAQIQQEKNAYELQKLDKWASLWEWF-NH2 | 1497 |

TABLE V-continued

| T No. | Sequence | Seq. ID No. |
|---|---|---|
| 1637 | Ac-WQEWEQKITALLEQAQIQQEKNEAELQKLDKWASLWEWF-NH2 | 1498 |
| 1644 | Ac-EYDLRRWEK-NH2 | 1499 |
| 1645 | Ac-EQELLELDK-NH2 | 1500 |
| 1646 | Ac-EYELQKLDK-NH2 | 1501 |
| 1647 | Ac-WQEWEQKITALLEQAQIQQEKNEQELLKLDKWASLWEWF-NH2 | 1502 |
| 1648 | Ac-WQEWEQKITALLEQAQIQQEKNEQELLELDKWASLWEWF-NH2 | 1503 |
| 1649 | Ac-WQEWEQKITALLEQAQIQQEKNDKWASLWEWF-NH2 | 1504 |
| 1650 | Ac-YTSLIHSLIEESQNQAEKNEQELLELDKWASLWNWF-NH2 | 1505 |
| 1651 | Ac-YTSLIHSLIEESQNQQAKNEQELLELDKWASLWNWF-NH2 | 1506 |
| 1652 | Ac-YTSLIHSLIEESQNQQEANEQELLELDKWASLWNWF-NH2 | 1507 |
| 1653 | Ac-YTSLIHSLIEESANQQEANEQELLELDKWASLWNWF-NH2 | 1508 |
| 1654 | Ac-YTSLIHSLIEESQAQQEKNEQELLELDKWASLWNWF-NH2 | 1509 |
| 1655 | Ac-YTSLIHSLIEESQNAQEKNEQELLELDKWASLWNWF-NH2 | 1510 |
| 1656 | Ac-YTSLIHALIEESQNQQEKNEQELLELDKWASLWNWF-NH2 | 1511 |
| 1657 | Ac-YTSLIHSAIEESQNQQEKNEQELLELDKWASLWWWF-NH2 | 1512 |
| 1658 | Ac-VYPSDEYDASISQVNEEINQALAYIPKADELLENV-NH2 | 1513 |
| 1659 | Ac-YTSLIHSLAEESQNQQEKNEQELLELDKWASLWNWF-NH2 | 1514 |
| 1660 | Ac-YTSAIHSLIEESQNQQEKNEQELLELDKWASLWNWF-NH2 | 1515 |
| 1661 | Ac-YTSLAHSLIEESQNQQEKNEQELLELDKWASLWNWF-NH2 | 1516 |
| 1662 | Ac-YTSLIASLIEESQNQQEKNEQELLELDKWASLWNWF-NH2 | 1517 |
| 1663 | Ac-ATSLIHSLIEESQNQQEKNEQELLELDKWASLWNWF-NH2 | 1518 |
| 1664 | Ac-YASLIHSLIEESQNQQEKNEQELLELDKWASLWNWF-NH2 | 1519 |
| 1665 | Ac-YTALIHSLIEESQNQQEKNEQELLELDKWASLWNWF-NH2 | 1520 |
| 1666 | Ac-RIQDLEKYVEDTKIDLWSYNAELLVALENQ-NH2 | 1521 |
| 1667 | Ac-HTIDLTDSEMNKLFEKTRRQLREN-NH2 | 1522 |
| 1668 | Ac-SEMNKLFEKTRRQLREN-NH2 | 1523 |
| 1669 | Ac-VFPSDEADASISQVNEKINQSLAFIRKSDELLHNV-NH2 | 1524 |
| 1670 | Ac-VFPSDEFAASISQVNEKINQSLAFIRKSDELLHNV-NH2 | 1525 |
| 1671 | Ac-VFPSDEFDASISAVNEKINQSLAFIRKSDELLHNV-NH2 | 1526 |
| 1672 | Ac-VFPSDEFDASISQANEKINQSLAFIRKSDELLHNV-NH2 | 1527 |
| 1673 | Ac-VFPSDEFDASISQVAEKINQSLAFIRKSDELLHNV-NH2 | 1528 |
| 1674 | Ac-WQEWEQKITAALEQAQIQQEKNEYELQKLDKWASLWEWF-NH2 | 1529 |
| 1675 | Ac-WQEWEQKITALAEQAQIQQEKNEYELQKLDKWASLWEWF-NH2 | 1530 |
| 1676 | Ac-WQEWEQKITALLEQAAIQQEKNEYELQKLDKWASLWEWF-NH2 | 1531 |
| 1677 | Ac-WQEWEQKITALLEQAQAQQEKNEYELQKLDKWASLWEWF-NH2 | 1532 |
| 1678 | Ac-WQEWEQKITALLEQAQIAQEKNEYELQKLDKWASLWEWF-NH2 | 1533 |
| 1679 | Ac-WQEWEQKITALLEQAQIQAEKNEYELQKLDKWASLWEWF-NH2 | 1534 |
| 1680 | Ac-VFPSDEFDASISQVNEKINQSAAFIRKSDELLHNV-NH2 | 1535 |
| 1681 | Ac-VFPSDEFDASISQVNEKINQSLAAIRKSDELLHNV-NH2 | 1536 |
| 1682 | Ac-VFPSDEFDASISQVNEKINQSLAFIRKSDEALHNV-NH2 | 1537 |
| 1683 | Ac-VFPSDEFDASISQVNEKINQSLAFIRKSDELAHNV-NH2 | 1538 |
| 1684 | Ac-VFPSDEFDASISQVNEKINQSLAFIRKSDELLANV-NH2 | 1539 |
| 1685 | Ac-WQEWEQKITALLEQAQIQQAKNEYELQKLDKWASLWEWF-NH2 | 1540 |
| 1687 | Ac-WQEWEQKITALLEQAQIQQEKNEYELQALDKWASLWEWF-NH2 | 1541 |
| 1688 | Ac-WQEWEQKITALLEQAQIQQEKNEYELQKADKWASLWEWF-NH2 | 1542 |
| 1772 | AVSKVLHLEGEVNKIKSALLSTKKAVVSLSNGVSVLTSKVLDLKNYIDKQ | 1551 |

5.3. RSV DP107-Like and DP178-Like Peptides

In one particularly preferred embodiment, the present invention relates to DP107-like and DP178-like peptides derived from HR1 and HR2-domains, respectfully of the $F_1$ domain of the respiratory syncytial virus F protein (RSV F-protein). The amino acid sequence of the full length RSV F-protein is shown in FIG. 25. The full length protein is comprises of two subunits, known in the art as the $F_1$ subunit (or $F_1$ domain; amino acid residues 137–574) and the $F_2$ subunit (or $F_2$ domain; amino acid residues 1–136), respectively.

The invention relates, first to a peptide referred to herein as T112, comprising the amino acid sequence

X-VFPSDEFDASISQVNEKINQSLAFIRKSDELLHNV-Z (SEQ ID NO:##)

The amino acid sequence of T112 corresponds to amino acid residues 482–513 of the RSV F protein. In particular, this region of the RSV F protein corresponds to an HR2 domain. Thus, T112 is a DP178-like peptide.

The invention further relates to novel DP107-like peptides having amino acid sequences from an HR1 domain of the RSV F-protein. In particular, the novel RSV DP107-like peptides of the invention comprise amino acid sequences corresponding to amino acid residues 142–207, more preferably amino acid residues 150–203 and still more preferably to amino acid residues 157–202 of the RSV F-protein or to portions thereof.

The Example presented in Section 14, below, describes experiments wherein the HR1 region of the RSV-F protein's F1 domain is precisely identified. In particular, the carboxy terminal of the HR1 domain is shown to comprise the amino acid sequence VLHLE (i.e., amino acid residues 157–161 of the RSV F-protein). The C-terminus of this HR1 is also determined to lie somewhere within the amino acid sequence LKNYIDKQ (i.e., between amino acid residues 195–202 of the RSV F-protein). Peptides derived from the amino acid sequence of this HR1 region are also demonstrated to associate with RSV DP178-like peptides in solution and possess potent antiviral activity. Thus, peptides having amino acid sequences corresponding to this HR1 region are among the DP107-like peptides of the present invention.

The RSV D107-like peptides of the invention include, in particular, the peptide referred to herein as T1772. T1772 comprises the amino acid sequence:

AVSKVLHLEGEVNKIKSALLSTNKAVVSLS NGVSVLTSKVLDLKNYIDKQ (SEQ ID NO:##), and corresponds to amino acid residues 153–202 of the RSV F-protein. In addition to the full length T1772 50-mer, the RSV DP107-like peptides of the invention may include truncations of the T1772 peptide which exhibit antifusogenic activity, antiviral activity, and/or the ability to form or modulate coiled-coil peptide structures. Truncations of the T1772 peptides may comprise peptides between 3 and 50 amino acid residues (i.e., peptides rangin in size from a tripeptide to a 50-mer peptide) as shown below. Such truncations of the T1772 peptides include, e.g., amino-terminal and carboxy-terminal truncations of the T112 peptide. Exemplary amino terminal truncations of the T112 peptide which are also among the RSV DP107-like peptides of the invention include peptides comprising the following amino acid sequences:

X-AVSKVLHLEGEVNKIKSALLSTNKAVVSLSNGVSVLTSKVLDLKNYIDKQ-Z;
X-SKVLHLEGEVNKIKSALLSTNKAVVSLSNGVSVLTSKVLDLKNYIDKQ-Z;
X-KVLHLEGEVNKIKSALLSTNKAVVSLSNGVSVLTSKVLDLKNYIDKQ-Z;
X-VLHLEGEVNKIKSALLSTNKAVVSLSNGVSVLTSKVLDLKNYIDKQ-Z;
X-LHLEGEVNKIKSALLSTNKAVVSLSNGVSVLTSKVLDLKNYIDKQ-Z;
X-HLEGEVNKIKSALLSTNKAVVSLSNGVSVLTSKVLDLKNYIDKQ-Z;
X-LEGEVNKIKSALLSTNKAVVSLSNGVSVLTSKVLDLKNYIDKQ-Z;
X-EGEVNKIKSALLSTNKAVVSLSNGVSVLTSKVLDLKNYIDKQ-Z;
X-GEVNKIKSALLSTNKAVVSLSNGVSVLTSKVLDLKNYIDKQ-Z;
X-EVNKIKSALLSTNKAVVSLSNGVSVLTSKVLDLKNYIDKQ-Z;
X-VNKIKSALLSTNKAVVSLSNGVSVLTSKVLDLKNYIDKQ-Z;
X-NKIKSALLSTNKAVVSLSNGVSVLTSKVLDLKNYIDKQ-Z;
X-KIKSALLSTNKAVVSLSNGVSVLTSKVLDLKNYIDKQ-Z;
X-IKSALLSTNKAVVSLSNGVSVLTSKVLDLKNYIDKQ-Z;
X-KSALLSTNKAVVSLSNGVSVLTSKVLDLKNYIDKQ-Z;
X-SALLSTNKAVVSLSNGVSVLTSKVLDLKNYIDKQ-Z;
X-ALLSTNKAVVSLSNGVSVLTSKVLDLKNYIDKQ-Z;
X-LLSTNKAVVSLSNGVSVLTSKVLDLKNYIDKQ-Z;
X-LSTNKAVVSLSNGVSVLTSKVLDLKNYIDKQ-Z;
X-STNKAVVSLSNGVSVLTSKVLDLKNYIDKQ-Z;
X-TNKAVVSLSNGVSVLTSKVLDLKNYIDKQ-Z;
X-NKAVVSLSNGVSVLTSKVLDLKNYIDKQ-Z;
X-KAVVSLSNGVSVLTSKVLDLKNYIDKQ-Z;
X-AVVSLSNGVSVLTSKVLDLKNYIDKQ-Z;
X-VVSLSNGVSVLTSKVLDLKNYIDKQ-Z;
X-VSLSNGVSVLTSKVLDLKNYIDKQ-Z;
X-SLSNGVSVLTSKVLDLKNYIDKQ-Z;
X-LSNGVSVLTSKVLDLKNYIDKQ-Z;
X-SNGVSVLTSKVLDLKNYIDKQ-Z;
X-NGVSVLTSKVLDLKNYIDKQ-Z;
X-GVSVLTSKVLDLKNYIDKQ-Z;
X-VSVLTSKVLDLKNYIDKQ-Z;
X-VLTSKVLDLKNYIDKQ-Z;
X-LTSKVLDLKNYIDKQ-Z;
X-TSKVLDLKNYIDKQ-Z;
X-SKVLDLKNYIDKQ-Z;
X-KVLDLKNYIDKQ-Z;
X-VLDLKNYIDKQ-Z;
X-LDLKNYIDKQ-Z;
X-DLKNYIDKQ-Z;
X-LKNYIDKQ-Z;
X-KNYIDKQ-Z;
X-NYIDKQ-Z;
X-YIDKQ-Z;
X-IDKQ-Z;
and X-DKQ-Z.
(SEQ ID NOS: ##–##, respectively)

Exemplary amino terminal truncations of the T112 peptide which are also among the RSV DP107-like peptides of the invention include peptides comprising the following amino acid sequences:

X-AVSKVLHLEGEVNKIKSALLSTNKAVVSLSNGVSVLTSKVLDLKNYIDKQ-Z;
X-AVSKVLHLEGEVNKIKSALLSTNKAVVSLSNGVSVLTSKVLDLKNYIDK-Z;
X-AVSKVLHLEGEVNKIKSALLSTNKAVVSLSNGVSVLTSKVLDLKNYID-Z;
X-AVSKVLHLEGEVNKIKSALLSTNKAVVSLSNGVSVLTSKVLDLKNYI-Z;
X-AVSKVLHLEGEVNKIKSALLSTNKAVVSLSNGVSVLTSKVLDLKNY-Z;
X-AVSKVLHLEGEVNKIKSALLSTNKAVVSLSNGVSVLTSKVLDLKN-Z;
X-AVSKVLHLEGEVNKIKSALLSTNKAVVSLSNGVSVLTSKVLDLK-Z;
X-AVSKVLHLEGEVNKIKSALLSTNKAVVSLSNGVSVLTSKVLDL-Z;
X-AVSKVLHLEGEVNKIKSALLSTNKAVVSLSNGVSVLTSKVLD-Z;
X-AVSKVLHLEGEVNKIKSALLSTNKAVVSLSNGVSVLTSKVL-Z;
X-AVSKVLHLEGEVNKIKSALLSTNKAVVSLSNGVSVLTSKV-Z;
X-AVSKVLHLEGEVNKIKSALLSTNKAVVSLSNGVSVLTSK-Z;
X-AVSKVLHLEGEVNKIKSALLSTNKAVVSLSNGVSVLTS-Z;
X-AVSKVLHLEGEVNKIKSALLSTNKAVVSLSNGVSVLT-Z;
X-AVSKVLHLEGEVNKIKSALLSTNKAVVSLSNGVSVL-Z;
X-AVSKVLHLEGEVNKIKSALLSTNKAVVSLSNGVSV-Z;
X-AVSKVLHLEGEVNKIKSALLSTNKAVVSLSNGVS-Z;
X-AVSKVLHLEGEVNKIKSALLSTNKAVVSLSNGV-Z;
X-AVSKVLHLEGEVNKIKSALLSTNKAVVSLSNG-Z;
X-AVSKVLHLEGEVNKIKSALLSTNKAVVSLSN-Z;
X-AVSKVLHLEGEVNKIKSALLSTNKAVVSLS-Z;
X-AVSKVLHLEGEVNKIKSALLSTNKAVVSL-Z;
X-AVSKVLHLEGEVNKIKSALLSTNKAVVS-Z;
X-AVSKVLHLEGEVNKIKSALLSTNKAVV-Z;
X-AVSKVLHLEGEVNKIKSALLSTNKAV-Z;
X-AVSKVLHLEGEVNKIKSALLSTNKA-Z;
X-AVSKVLHLEGEVNKIKSALLSTNK-Z;
X-AVSKVLHLEGEVNKIKSALLSTN-Z;
X-AVSKVLHLEGEVNKIKSALLST-Z;
X-AVSKVLHLEGEVNKIKSALLS-Z;
X-AVSKVLHLEGEVNKIKSALL-Z;
X-AVSKVLHLEGEVNKIKSAL-Z;
X-AVSKVLHLEGEVNKIKSA-Z;
X-AVSKVLHLEGEVNKIKS-Z;
X-AVSKVLHLEGEVNKIK-Z;
X-AVSKVLHLEGEVNKI-Z;
X-AVSKVLHLEGEVNK-Z;
X-AVSKVLHLEGEVN-Z;
X-AVSKVLHLEGEV-Z;
X-AVSKVLHLEGE-Z;
X-AVSKVLHLEG-Z;
X-AVSKVLHLE-Z;
X-AVSKVLHL-Z;
X-AVSKVLH-Z;
X-AVSKVL-Z;
X-AVSKV-Z;
X-AVSK-Z; and
X-AVS-X (SEQ ID NOS: ##–##, respectively).

In a particularly preferred aspect of this embodiment, the RSV DP107-like peptides of the invention include the peptide referred to herein as T1581, which comprises the amino acid sequence:

X-VLHLEGEVNKIKSALLSTNKAVVSLSNGVSVLTSKVLDLKNYIDKQ-Z (SEQ ID NO:##).

T1581 is a peptide 45 amino acid residues in length and corresponds to amino acid residues 157–202 of the RSV F-protein. The RSV DP107-like peptides of the invention also include peptides which comprises truncations of the T1581 amino acid sequence including amino-terminal and/or carboxy-terminal truncations of the T1581 amino acid sequence. Such truncations include, but are not limited to, the following carboxy terminal truncations:

X-VLHLEGEVNKIKSALLSTNKAVVSLSNGVSVLTSKVLDLKNYIDKQ-Z;
X-VLHLEGEVNKIKSALLSTNKAVVSLSNGVSVLTSKVLDLKNYIDK-Z;
X-VLHLEGEVNKIKSALLSTNKAVVSLSNGVSVLTSKVLDLKNYID-Z;
X-VLHLEGEVNKIKSALLSTNKAVVSLSNGVSVLTSKVLDLKNYI-Z;
X-VLHLEGEVNKIKSALLSTNKAVVSLSNGVSVLTSKVLDLKNY-Z;
X-VLHLEGEVNKIKSALLSTNKAVVSLSNGVSVLTSKVLDLKN-Z;
X-VLHLEGEVNKIKSALLSTNKAVVSLSNGVSVLTSKVLDLK-Z;
X-VLHLEGEVNKIKSALLSTNKAVVSLSNGVSVLTSKVLDL-Z;
X-VLHLEGEVNKIKSALLSTNKAVVSLSNGVSVLTSKVLD-Z;
X-VLHLEGEVNKIKSALLSTNKAVVSLSNGVSVLTSKVL-Z;
X-VLHLEGEVNKIKSALLSTNKAVVSLSNGVSVLTSKV-Z;
X-VLHLEGEVNKIKSALLSTNKAVVSLSNGVSVLTSK-Z;
X-VLHLEGEVNKIKSALLSTNKAVVSLSNGVSVLTS-Z;

-continued

X-VLHLEGEVNKIKSALLSTNKAVVSLSNGVSVLT-Z;
X-VLHLEGEVNKIKSALLSTNKAVVSLSNGVSVL-Z;
X-VLHLEGEVNKIKSALLSTNKAVVSLSNGVSV-Z;
X-VLHLEGEVNKIKSALLSTNKAVVSLSNGVS-Z;
X-VLHLEGEVNKIKSALLSTNKAVVSLSNGV-Z;
X-VLHLEGEVNKIKSALLSTNKAVVSLSNG-Z;
X-VLHLEGEVNKIKSALLSTNKAVVSLSN-Z;
X-VLHLEGEVNKIKSALLSTNKAVVSLS-Z;
X-VLHLEGEVNKIKSALLSTNKAVVSL-Z;
X-VLHLEGEVNKIKSALLSTNKAVVS-Z;
X-VLHLEGEVNKIKSALLSTNKAVV-Z;
X-VLHLEGEVNKIKSALLSTNKAV-Z;
X-VLHLEGEVNKIKSALLSTNKA-Z;
X-VLHLEGEVNKIKSALLSTNK-Z;
X-VLHLEGEVNKIKSALLSTN-Z;
X-VLHLEGEVNKIKSALLST-Z;
X-VLHLEGEVNKIKSALLS-Z;
X-VLHLEGEVNKIKSALL-Z;
X-VLHLEGEVNKIKSAL-Z;
X-VLHLEGEVNKIKSA-Z;
X-VLHLEGEVNKIKS-Z;
X-VLHLEGEVNKIK-Z;
X-VLHLEGEVNKI-Z;
X-VLHLEGEVNK-Z;
X-VLHLEGEVN-Z;
X-VLHLEGEV-Z;
X-VLHLEGE-Z;
X-VLHLEG-Z;
X-VLHLE-Z;
X-VLHL-Z; and
X-VLH-Z (SEQ ID NOS: ##-##, respectively).

"X" may represent an amino group (—NH$_2$) and "Z" may represent a carboxyl (—COOH) group. Alternatively, "X" may represent a hydrophobic group, including but not limited to carbobenzyl, dansyl or T-butoxycarbonyl; an acetyl group; a 9-fluorenylmethoxy-carbonyl (FMOC) group; or a covalently attached macrommolecular group, including but not limited to a lipid-fatty acid conjugate, polyethylene glycol, carbohydrate or peptide group. Further, "Z" may represent an amido group; a T-butoxycarbonyl group; or a covalently attached macromolecular group, including but not limited to a lipid-fatty acid conjugate, polyethylene glycol, carbohydrate or peptide group. A preferred "X" or "Z" macromolecular group is a peptide group.

Other, exemplary RSV DP107-like peptides of the invention include the peptides depicted in FIG. 28. Such peptides include, for example, the peptides T1536, T1590, T1585 and T1582 as well as other peptides, not necessarily shown in FIG. 28, comprising both carboxy-terminal and amino-terminal truncations of a T1772 peptide. In addition, peptides such as T1584 and T1623, which are also shown in FIG. 28 and which contain additional carboxy-terminal and/or amino-terminal amino acid residues are also among the RSV DP107-like peptides of the present invention.

5.4. Synthesis of Peptides

The peptides of the invention may be synthesized or prepared by techniques well known in the art. See, for example, Creighton, 1983, Proteins: Structures and Molecular Principles, W.H. Freeman and Co., NY, which is incorporated herein by reference in its entirety. Short peptides, for example, can be synthesized on a solid support or in solution. Longer peptides may be made using recombinant DNA techniques. Here, the nucleotide sequences encoding the peptides of the invention may be synthesized, and/or cloned, and expressed according to techniques well known to those of ordinary skill in the art. See, for example, Sambrook, et al., 1989, Molecular Cloning, A Laboratory Manual, Vols. 1–3, Cold Spring Harbor Press, NY.

The peptides of the invention may alternatively be synthesized such that one or more of the bonds which link the amino acid residues of the peptides are non-peptide bonds. These alternative non-peptide bonds may be formed by utilizing reactions well known to those in the art, and may include, but are not limited to imino, ester, hydrazide, semicarbazide, and azo bonds, to name but a few. In yet another embodiment of the invention, peptides comprising the sequences described above may be synthesized with additional chemical groups present at their amino and/or carboxy termini, such that, for example, the stability, bioavailability, and/or inhibitory activity of the peptides is enhanced. For example, hydrophobic groups such as carbobenzoxyl, dansyl, or t-butyloxycarbonyl groups, may be added to the peptides' amino termini. Likewise, an acetyl group or a 9-fluorenylmethoxy-carbonyl group may be placed at the peptides' amino termini. (See "X" Tables I to IV, above.) Additionally, the hydrophobic group, t-butyloxycarbonyl, or an amido group may be added to the peptides' carboxy termini. (See "Z" in Tables I to IV, above.)

Further, the peptides of the invention may be synthesized such that their steric configuration is altered. For example, the D-isomer of one or more of the amino acid residues of the peptide may be used, rather than the usual L-isomer.

Still further, at least one of the amino acid residues of the peptides of the invention may be substituted by one of the well known non-naturally occurring amino acid residues. Alterations such as these may serve to increase the stability, bioavailability and/or inhibitory action of the peptides of the invention.

Any of the peptides described above may, additionally, have a macromolecular carrier group covalently attached to their amino and/or carboxy termini. Such macromolecular carrier groups may include, for example, lipid-fatty acid conjugates, polyethylene glycol, carbohydrates or additional peptides. "X", in Tables I to IV, above, may therefore additionally represent any of the above macromolecular carrier groups covalently attached to the amino terminus of a peptide, with an additional peptide group being preferred. Likewise, "Z", in Tables I to IV, may additionally represent any of the macromolecular carrier groups described above.

5.5. Assays for Anti-membrane Fusion Activity

Described herein, are methods for ability of a compound, such as the peptides of the invention, to inhibit membrane fusion events. Specifically, assays for cell fusion events are described in Section 5.6.1, below, and assays for antiviral activity are described in Section 5.6.2, below.

5.5.1. Assays for Cell Fusion Events

Assays for cell fusion events are well known to those of skill in the art, and may be used in conjunction, for example, with the peptides of the invention to test the peptides' antifusogenic capabilities.

Cell fusion assays are generally performed in vitro. Such an assay may comprise culturing cells which, in the absence of any treatment would undergo an observable level of syncytial formation. For example, uninfected cells may be incubated in the presence of cells chronically infected with a virus that induces cell fusion. Such viruses may include, but are not limited to, HIV, SIV, or respiratory syncytial virus.

For the assay, cells are incubated in the presence of a peptide to be assayed. For each peptide, a range of peptide concentrations may be tested. This range should include a control culture wherein no peptide has been added.

Standard conditions for culturing cells, well known to those of ordinary skill in the art, are used. After incubation for an appropriate period (24 hours at 37° C., for example) the culture is examined microscopically for the presence of multinucleated giant cells, which are indicative of cell fusion and syncytial formation. Well known stains, such as crystal violet stain, may be used to facilitate the visualization of syncytial formation.

Exemplary cell fusion assays are described, below, in Section 6 (for HIV) and Section 11 (RSV).

5.5.2. Assays for Antiviral Activity

The antiviral activity exhibited by the peptides of the invention may be measured, for example, by easily performed in vitro assays, such as those described below, which can test the peptides' ability to inhibit syncytia formation, or their ability to inhibit infection by cell-free virus. Using these assays, such parameters as the relative antiviral activity of the peptides, exhibit against a given strain of virus and/or the strain specific inhibitory activity of the peptide can be determined.

A cell fusion assay may be utilized to test the peptides' ability to inhibit viral-induced, such as HIV-induced, syncytia formation in vitro. Such an assay may comprise culturing uninfected cells in the presence of cells chronically infected with a syncytial-inducing virus and a peptide to be assayed. For each peptide, a range of peptide concentrations may be tested. This range should include a control culture wherein no peptide has been added. Standard conditions for culturing, well known to those of ordinary skill in the art, are used. After incubation for an appropriate period (24 hours at 37° C., for example) the culture is examined microscopically for the presence of multinucleated giant cells, which are indicative of cell fusion and syncytia formation. Well known stains, such as crystal violet stain, may be used to facilitate syncytial visualization. Taking HIV as an example, such an assay would comprise CD-4$^+$ cells (such as Molt or CEM cells, for example) cultured in the presence of chronically HIV-infected cells and a peptide to be assayed.

Other well known characteristics of viral infection may also be assayed to test a peptide's antiviral capabilities. Once again taking HIV as an example, a reverse transcriptase (RT) assay may be utilized to test the peptides' ability to inhibit infection of CD-4$^+$ cells by cell-free HIV. Such an assay may comprise culturing an appropriate concentration (i.e., TCID$_{50}$) of virus and CD-4$^+$ cells in the presence of the peptide to be tested. Culture conditions well known to those in the art are used. As above, a range of peptide concentrations may be used, in addition to a control culture wherein no peptide has been added. After incubation for an appropriate period (e.g. 7 days) of culturing, a cell-free supernatant is prepared, using standard procedures, and tested for the present of RT activity as a measure of successful infection. The RT activity may be tested using standard techniques such as those described by, for example, Goff et al. (Goff, S. et al., 1981, J. Virol. 38:239–248) and/or Willey.et al. (Willey, R. et al., 1988, J. Virol. 62:139–147). These references are incorporated herein by reference in their entirety.

Standard methods which are well-known to those of skill in the art may be utilized for assaying non-retroviral activity. See, for example, Pringle et al. (Pringle, C. R. et al., 1985, J. Medical Virology 17:377–386) for a discussion of respiratory syncytial virus and parainfluenza virus activity assay techniques. Further, see, for example, "Zinsser Microbiology", 1988, Joklik, W. K. et al., eds., Appleton & Lange, Norwalk, Conn., 19th ed., for a general review of such techniques. These references are incorporated by reference herein in their entirety. In addition, the Examples presented below, in Sections 17, 18, 26 and 27 each provide additional assays for the testing of a compound's antiviral capability.

In vivo assays may also be utilized to test, for example, the antiviral activity of the peptides of the invention. To test for anti-HIV activity, for example, the in vivo model described in Barnett et al. (Barnett, S. W. et al., 1994, Science 266:642–646) may be used.

Additionally, anti-RSV activity can be assayed in vivo via well known mouse models. For example, RSV can be administered intranasally to mice of various inbred strains. Virus replicates in lungs of all strains, but the highest titers are obtained in P/N, C57L/N and DBA/2N mice. Infection of BALB/c mice produces an asymptomatic bronchiolitis characterized by lymphocytic infiltrates and pulmonary virus titers of $10^4$ to $10^5$ pfu/g of lung tissue (Taylor, G. et al., 1984, Infect. Immun. 43:649–655).

Cotton rat models of RSV are also well known (see, e.g., Johnson et al., 1999, *Journal of Infectious Diseases* 180:35–40; Prince et al., 1985, *J. Virol.* 55:517–520). Virus replicates to high titer in the nose and lungs of the cotton rat but produces few if any signs of inflammation.

5.6. Uses of the Peptides of the Invention

The peptides of the invention may be utilized as antifusogenic or antiviral compounds, or as compounds which modulate intracellular processes involving coiled coil peptide structures. Further, such peptides may be used to identify agents which exhibit antifusogenic, antiviral or intracellular modulatory activity. Still further, the peptides of the invention may be utilized as organism or viral type/subtype-specific diagnostic tools.

5.6.1. Inhibition of Viral Infection

The antifusogenic capability of the peptides of the invention may additionally be utilized to inhibit or treat/ameliorate symptoms caused by processes involving membrane fusion events. Such events may include, for example, virus transmission via cell-cell fusion, abnormal neurotransmitter exchange via cell-fusion, and sperm-egg fusion.

Further, the peptides of the invention may be used to inhibit free viral, such as retroviral, particularly HIV, transmission to uninfected cells wherein such viral infection involves membrane fusion events or involves fusion of a viral structure with a cell membrane. Among the intracellular disorders involving coiled coil peptides structures which may be ameliorated by the peptides of the invention are disorders involving, for example, bacterial toxins.

With respect to antiviral activity, the viruses whose transmission may be inhibited by the peptides of the invention include, but are not limited to human retroviruses, such as HIV-1 and HIV-2 and the human T-lymphocyte viruses (HTLV-I and II), and non-human retroviruses such as bovine leukosis virus, feline sarcoma and leukemia viruses, simian immunodeficiency, sarcoma and leukemia viruses, and sheep progress pneumonia viruses.

Non retroviral viruses whose transmission may be inhibited by the peptides of the invention include, but are not limited to human respiratory syncytial virus, canine distemper virus, newcastle disease virus, human parainfluenza virus, influenza viruses, measles viruses, Epstein-Barr viruses, hepatitis B viruses, and simian Mason-Pfizer viruses.

Non enveloped viruses whose transmission may be inhibited by the peptides of the invention include, but are not limited to picornaviruses such as polio viruses, hepatitis A virus, enterovirus, echoviruses and coxsackie viruses, papovaviruses such as papilloma virus, parvoviruses, adenoviruses and reoviruses.

As discussed more fully, below, in Section 5.7.1 and in the Example presented, below, in Section 8, DP107, DP178, DP107 analog and DP178 analog peptides form non-covalent protein-protein interactions which are required for normal activity of the virus. Thus, the peptides of the invention may also be utilized as components in assays for the identification of compounds that interfere with such protein-protein interactions and may, therefore, act as antiviral agents. These assays are discussed, below, in Section 5.7.1.

5.6.2. Diagnostic Applications

As demonstrated in the Example presented below in Section 6, the antiviral activity of the peptides of the invention may show a pronounced type and subtype specificity, i.e., specific peptides may be effective in inhibiting the activity of only specific viruses. This feature of the invention presents many advantages. One such advantage, for example, lies in the field of diagnostics, wherein one can use the antiviral specificity of the peptide of the invention to ascertain the identity of a viral isolate. With respect to HIV, one may easily determine whether a viral isolate consists of an HIV-1 or HIV-2 strain. For example, uninfected CD-4$^+$ cells may be co-infected with an isolate which has been identified as containing HIV and the DP178 (SEQ ID NO:15) peptide after which the retroviral activity of cell supernatants may be assayed, using, for example, the techniques described above in Section 5.2. Those isolates whose retroviral activity is completely or nearly completely inhibited contain HIV-1. Those isolates whose viral activity is unchanged or only reduced by a small amount, may be considered to not contain HIV-1. Such an isolate may then be treated with one or more of the other DP178 peptides of the invention, and subsequently be tested for its viral activity in order to determine the identity of the viral isolate. The DP107 and DP178 analogs of the invention may also be utilized in a diagnostic capacity specific to the type and subtype of virus or organism in which the specific peptide sequence is found. A diagnostic procedure as described, above, for DP178, may be used in conjunction with the DP107/DP178 analog of interest.

5.6.3. Screening Assays

As demonstrated in the Example presented in Section 8, below, DP107 and DP178 portions of the TM protein gp41, i.e., the HR1 and HR2 portions of gp41, respectively, form non-covalent protein-protein interactions. As is also demonstrated, the maintenance of such interactions is necessary for normal viral infectivity. Thus, compounds which bind DP107, bind DP178, and/or act to disrupt normal DP107/DP178 protein-protein interactions may act as antifusogenic, antiviral or cellular modulatory agents. Described below are assays for the identification of such compounds. Note that, while, for ease and clarity of discussion, DP107 and DP178 peptides will be used as components of the assays described, but it is to be understood that any of the DP107 analog or DP178 analog peptides described, above, in Sections 5.1 through 5.3 may also be utilized as part of these screens for compounds.

For example, in certain embodiments the assays of the invention may be use DP107 and/or DP178 analogs that contain one or more amino acid residue truncations, deletions, insertions or substitutions. In particular, in one preferred embodiment, the DP107, DP178, DP107-like and DP178-like peptides can comprise amino and/or carboxy-terminal insertions corresponding to about two to about fifty amino acids amino-to or carboxy-to the endogenous sequence from which the DP107, DP178, DP107-like or DP178-like peptide is derived. In another particular embodiment, the peptides used in the assays described herein further comprise additional, heterologous sequence useful for detecting, immobilizing and/or purifying the particular peptide. Such heterologous sequences include, but are not limited to maltose binding fusion proteins containing a DP178, DP107, DP178-like or DP107-like sequence such as the M41A178 and MF5.1 maltose binding fusion proteins described in Sections 8 and 30, below.

In certain embodiments, such analogs will have reduced binding affinities and are therefore useful, e.g., to screen for compounds which inhibit the formation of or, alternatively, disrupt complexes between DP107/DP178 complexes. Among such reduced binding analogs are peptides exhibiting one or more alanine insertion or substitutions, including, e.g., the peptides described in the examples presented in Sections 30 and 31, below. It is understood that such analogs which have reduced binding affinities, including the analogs described in Sections 30 and 31 below, are also part of the present invention.

Compounds which may be tested for an ability to bind DP107, DP178, and/or disrupt DP107/DP178 interactions, and which therefore, potentially represent antifusogenic, antiviral or intracellular modulatory compounds, include, but are not limited to, peptides made of D- and/or L-configuration amino acids (in, for example, the form of random peptide libraries; see Lam, K. S. et al., 1991, Nature 354:82–84), phosphopeptides (in, for example, the form of random or partially degenerate, directed phosphopeptide libraries; see, for example, Songyang, Z. et al., 1993, Cell 72:767–778), antibodies, and small organic or inorganic molecules. Synthetic compounds, natural products, and other sources of potentially effective materials may be screened in a variety of ways, as described in this Section.

Compounds that can be screened, tested and identified as modulating HR1/HR2, DP178/DP107 and/or DP178-like/DP107-like interactions utilizing the methods described herein can, in general, include, e.g., small molecules that are of a molecular weight up to about 1500 daltons. Test compounds, including small molecules, can include, but are not limited to, compounds obtained from any commercial source, including Aldrich (1001 West St. Paul Ave., Milwaukee, Wis. 53233), Sigma Chemical (P.O. Box 14508, St. Louis, Mo. 63178), Fluka Chemie AG (Industriestrasse 25, CH-9471 Buchs, Switzerland (Fluka Chemical Corp. 980 South 2nd Street, Ronkonkoma, N.Y. 11779)), Eastman Chemical Company, Fine Chemicals (P.O Box 431, Kingsport, Tenn. 37662), Boehringer Mannheim GmbH (Sandhofer Strasse 116, D-68298 Mannheim), Takasago (4 Volvo Drive, Rockleigh, N.J. 07647), SST Corporation (635 Brighton Road, Clifton, N.J. 07012), Ferro (111 West Irene Road, Zachary, La. 70791), Riedel-deHaen Aktiengesellschaft (P.O. Box D-30918, Seelze, Germany), PPG Industries Inc., Fine Chemicals (One PPG Place, 34th Floor, Pittsburgh, Pa. 15272). Further any kind of natural products may be screened using the methods of the invention, including microbial, fungal or plant extracts.

Furthermore, diversity libraries of test compounds, including small molecule test compounds, may be commercially obtained from Specs and BioSpecs B.V. (Rijswijk, The Netherlands), Chembridge Corporation (San Diego, Calif.), Contract Service Company (Dolgoprudny, Moscow Region, Russia), Comgenex USA Inc. (Princeton, N.J.), Maybridge Chemicals Ltd. (Cornwall PL34 OHW, United Kingdom), and Asinex (Moscow, Russia). Combinatorial libraries of test compounds, including small molecule test compounds, can be may be generated as disclosed in Eichler & Houghten, 1995, *Mol. Med. Today* 1:174–180; Dolle, 1997. *Mol. Divers*. 2:223–236; Lam, 1997, *Anticancer Drug Des*. 12:145–167. These references are incorporated hereby by reference in their entirety. It is to be noted that such references also teach additional screening methods which may be employed for the further testing of compounds identified via the methods of the invention and which can aid in identifying and isolating compounds which can represent leads and therapeutic compounds.

The compounds, antibodies, or other molecules identified may be tested, for example, for an ability to inhibit cell fusion or viral activity, utilizing, for example, assays such as those described, above, in Section 5.6.

Among the peptides which may be tested are soluble peptides comprising DP107 and/or DP178 domains, and peptides comprising DP107 and/or DP178 domains having one or more mutations within one or both of the domains, such as the M41-P peptide described, below, in the Example presented in Section 8, which contains a isoleucine to proline mutation within the DP178 sequence.

In one embodiment of such screening methods is a method for identifying a compound to be tested for antiviral ability comprising:

(a) exposing at least one compound to a peptide comprising a DP107 peptide for a time sufficient to allow binding of the compound to the DP107 peptide;

(b) removing non-bound compounds; and (c) determining the presence of the compound bound to the DP107 peptide, thereby identifying an agent to be tested for antiviral ability.

In a second embodiment of such screening methods is a method for identifying a compound to be tested for antiviral ability comprising:

(a) exposing at least one compound to a peptide comprising a DP178 peptide for a time sufficient to allow binding of the compound to the DP178 peptide;

(b) removing non-bound compounds; and (c) determining the presence of the compound bound to the DP178 peptide, thereby identifying an agent to be tested for antiviral ability.

One method utilizing these types of approaches that may be pursued in the isolation of such DP107-binding or DP178-binding compounds is an assay which would include the attachment of either the DP107 or the DP178 peptide to a solid matrix, such as, for example, agarose or plastic beads, microtiter plate wells, petri dishes, or membranes composed of, for example, nylon or nitrocellulose. In such an assay system, either the DP107 or DP178 protein may be anchored onto a solid surface, and the compound, or test substance, which is not anchored, is labeled, either directly or indirectly (e.g., with a radioactive label such as $^{125}$I, an absorption label such as biotin, or a fluorescent label such as fluorescein or rhodamine). In practice, microtiter plates are conveniently utilized. The anchored component may be immobilized by non-covalent or covalent attachments. Non-covalent attachment may be accomplished simply by coating the solid surface with a solution of the protein and drying. Alternatively, an immobilized antibody, preferably a monoclonal antibody, specific for the protein may be used to anchor the protein to the solid surface. The surfaces may be prepared in advance and stored.

In order to conduct the assay, the labeled compound is added to the coated surface containing the anchored DP107 or DP178 peptide. After the reaction is complete, unreacted components are removed (e.g., by washing) under conditions such that any complexes formed will remain immobilized on the solid surface. The detection of complexes anchored on the solid surface can be accomplished in a number of ways. Where the compound is pre-labeled, the detection of label immobilized on the surface indicates that complexes were formed. Where the labeled component is not pre-labeled, an indirect label can be used to detect complexes anchored on the surface; e.g., using a labeled antibody specific for the compound (the antibody, in turn, may be directly labeled or indirectly labeled with a labeled anti-Ig antibody).

Alternatively, such an assay can be conducted in a liquid phase, the reaction products separated from unreacted components, and complexes detected; e,g., using an immobilized antibody specific for DP107 or DP178, whichever is appropriate for the given assay, or ab antibody specific for the compound, i.e., the test substance, in order to anchor any complexes formed in solution, and a labeled antibody specific for the other member of the complex to detect anchored complexes.

By utilizing procedures such as this, large numbers of types of molecules may be simultaneously screened for DP107 or DP178-binding capability, and thus potential antiviral activity.

Further, compounds may be screened for an ability to inhibit the formation of or, alternatively, disrupt DP107/DP178 complexes. Such compounds may then be tested for antifusogenic, antiviral or intercellular modulatory capability. For ease of description, DP107 and DP178 will be referred to as "binding partners." Compounds that disrupt such interactions may exhibit antiviral activity. Such compounds may include, but are not limited to molecules such as antibodies, peptides, and the like described above.

The basic principle of the assay systems used to identify compounds that interfere with the interaction between the DP107 and DP178 peptides involves preparing a reaction mixture containing peptides under conditions and for a time sufficient to allow the two peptides to interact and bind, thus forming a complex. In order to test a compound for disruptive activity, the reaction is conducted in the presence and absence of the test compound, i.e., the test compound may be initially included in the reaction mixture, or added at a time subsequent to the addition of one of the binding partners; controls are incubated without the test compound or with a placebo. The formation of any complexes between the binding partners is then detected. The formation of a complex in the control reaction, but not in the reaction mixture containing the test compound indicates that the compound interferes with the interaction of the DP107 and DP178 peptides.

The assay for compounds that interfere with the interaction of the binding partners can be conducted in a heterogeneous or homogeneous format. Heterogeneous assays involve anchoring one of the binding partners onto a solid phase and detecting complexes anchored on the solid phase at the end of the reaction. In homogeneous assays, the entire reaction is carried out in a liquid phase. In either approach, the order of addition of reactants can be varied to obtain different information about the compounds being tested.

For example, test compounds that interfere with the interaction between the binding partners, e.g., by competition, can be identified by conducting the reaction in the presence of the test substance; i.e., by adding the test substance to the reaction mixture prior to or simultaneously with the binding partners. On the other hand, test compounds that disrupt preformed complexes, e.g. compounds with higher binding constants that displace one of the binding partners from the complex, can be tested by adding the test compound to the reaction mixture after complexes have been formed. The various formats are described briefly below.

In a heterogeneous assay system, one binding partner, e.g., either the DP107 or DP178 peptide, is anchored onto a solid surface, and its binding partner, which is not anchored, is labeled, either directly or indirectly (e.g., with a radioactive label such as $^{125}I$, an absorption label such as biotin, or a fluorescent label such as fluorescein or rhodamine). In practice, microtiter plates are conveniently utilized. The anchored species may be immobilized by non-covalent or covalent attachments. Non-covalent attachment may be accomplished simply by coating the solid surface with a solution of the protein and drying. Alternatively, an immobilized antibody specific for the protein may be used to anchor the protein to the solid surface. The surfaces may be prepared in advance and stored.

In order to conduct the assay, the binding partner of the immobilized species is added to the coated surface with or without the test compound. After the reaction is complete, unreacted components are removed (e.g., by washing) and any complexes formed will remain immobilized on the solid surface. The detection of complexes anchored on the solid surface can be accomplished in a number of ways. Where the binding partner was pre-labeled, the detection of label immobilized on the surface indicates that complexes were formed. Where the binding partner is not pre-labeled, an indirect label can be used to detect complexes anchored on the surface; e.g., using a labeled antibody specific for the binding partner (the antibody, in turn, may be directly labeled or indirectly labeled with a labeled anti-Ig antibody). Depending upon the order of addition of reaction components, test compounds which inhibit complex formation or which disrupt preformed complexes can be detected.

Alternatively, the reaction can be conducted in a liquid phase in the presence or absence of the test compound, the reaction products separated from unreacted components, and complexes detected; e.g., using an immobilized antibody specific for one binding partner to anchor any complexes formed in solution, and a labeled antibody specific for the other binding partner to detect anchored complexes. Again, depending upon the order of addition of reactants to the liquid phase, test compounds which inhibit complex or which disrupt preformed complexes can be identified.

In an alternate embodiment of the invention, a homogeneous assay can be used. In this approach, a preformed complex of the DP107 and DP178 peptides is prepared in which one of the binding partners is labeled, but the signal generated by the label is quenched due to complex formation (see, e.g., U.S. Pat. No. 4,109,496 by Rubenstein which utilizes this approach for immunoassays). The addition of a test substance that competes with and displaces one of the binding partners from the preformed complex will result in the generation of a signal above background. In this way, test substances which disrupt DP-107/DP-178 protein-protein interaction can be identified.

In still another embodiment of the invention, fluorescence polarization may be used in a homogenous assay. In this approach, complex formation is detected by measuring the polarization of a fluorescently labeled peptide (e.g., with fluorescein or rhodamine) in a sample. Binding of the peptide to its complementary HR1 or HR2 binding domain in a larger molecular weight peptide or protein, such as in a maltose binding fusion protein described herein, alters the correlation time of the fluorescent moiety and thereby decreases the fluoescence polarization of the labeled peptide.

In an alternative screening assay, test compounds may be assayed for the their ability to disrupt a DP178/DP107 interaction, as measured immunometrically using an antibody specifically reactive to a DP107/DP178 complex (i.e., an antibody that recognizes neither DP107 nor DP178 individually). Such an assay acts as a competition assay, and is based on techniques well known to those of skill in the art.

The above competition assay may be described, by way of example, and not by way of limitation, by using the DP178 and M41Δ178 peptides and by assaying test compounds for the disruption of the complexes formed by these two peptides by immunometrically visualizing DP178/M41Δ178 complexes via the human recombinant Fab, Fab-d, as described, below, in the Example presented in Section 8. M41Δ178 is a maltose binding fusion protein containing a gp41 region having its DP178 domain deleted, and is described, below, in the Example presented in Section 8.

Utilizing such an assay, M41Δ178 may be immobilized onto solid supports such as microtiter wells. A series of dilutions of a test compound may then be added to each M41Δ178-containing well in the presence of a constant concentration of DP-178 peptide. After incubation, at, for example, room temperature for one hour, unbound DP-178 and test compound are removed from the wells and wells are then incubated with the DP178/M41Δ178-specific Fab-d antibody. After incubation and washing, unbound Fab-d is removed from the plates and bound Fab-d is quantitated. A no-inhibitor control should also be conducted. Test compounds showing an ability to disrupt DP178/M41Δ178 complex formation are identified by their concentration-dependent decrease in the level of Fab-d binding.

A variation of such an assay may be utilized to perform a rapid, high-throughput binding assay which is capable of directly measuring DP178 binding to M41Δ178 for the determination of binding constants of the ligand of inhibitory constants for competitors of DP178 binding.

Such an assay takes advantage of accepted radioligand and receptor binding principles. (See, for example, Yamamura, H. I. et al., 1985, "Neurotransmitter Receptor Binding", 2nd ed., Raven Press, NY.) As above, M41Δ78 is immobilized onto a solid support such as a microtiter well. DP178 binding to M41Δ178 is then quantitated by measuring the fraction of DP178 that is bound as $^{125}$I-DP178 and calculating the total amount bound using a value for specific activity (dpm/μg peptide) determined for each labeled DP178 preparation. Specific binding to M41Δ78 is defined as the difference of the binding of the labeled DP178 preparation in the microtiter wells (totals) and the binding in identical wells containing, in addition, excess unlabeled DP178 (nonspecifics).

Because the binding affinity for native DP178 and DP107 is very high (including native DP178-like and DP107-like peptides from other species; e.g., 10 nM for DP178 in HIV-1, and 2 nM for T112 in RSV), test compounds must exhibit high binding properties to interfere with or disrupt the DP178/DP107 binding interaction. Accordingly, in another non-limiting example of the above-described competitions assays, such assays can be performed using "modified" DP107 and/or DP178 peptides (e.g., DP107 and/or DP178 analogs) which have reduced binding affinities relatived to the unmodified "parent peptides". The use of such modified DP107 and DP178 peptides greatly increases the sensitivity of the competition assays of the invention by identifying more compounds with inhibitory potential. The binding affinities of compounds identified in the assays can then be optimized, e.g., using standard medicinal chemistry techniques, to generate compounds that are more powerful inhibitors of DP107/DP178 complex formation and are therefore useful, e.g., as antiviral reagents. Alternatively, compounds identified in the competition assays using DP107 and/or DP178 analogs with reduced binding affinities may, themselves, be useful, e.g., as antiviral reagents.

The term "reduced affinity," as used herein, refers to a DP107, DP178, DP107-like or DP178-like peptide that interacts with and forms a DP107/DP178 peptide pair, a HR1/DP178 pair or an HR2/DP107 pair under competition assay conditions, but interacts with its "partner" to form such a pair with a lower affinity than would a DP107 or DP178 "parent" peptide from which the reduced affinity peptide is derived.

Generally, the binding affinity of a peptide can be expressed as a $B_{50}$ value, i.e., the concentration of peptide necessary for 50% of the peptide molecules to bind to their target under a given set of conditions. Preferably, the $B_{50}$ value of a reduced affinity peptide will by at least twice, and more preferably at least five times, at least 10 times, at least 20 times, or at least 100 times the $B_{50}$ value of the unmodified peptide from which it was derived.

Modified DP107 and DP178 peptides that have reduced binding affinities may be generated according to any number of techniques that will be readily apparent to those skilled in the art. For example, in one embodiment modified DP107 and DP178 peptides with reduced binding affinities may be generated by generating truncated DP107 and DP178 peptides, respectively. Such peptides may be routinely synthesized and tested, e.g., by the above described screening assays, to determine their binding affinities to their target. For example, as described in the example presented below in Section 30, reducing the length of the native RSV DP178-like peptide T112 from 35 to 28 amino acid residues resulted in a five fold drop in binding affinity (from 1 nM to 5 nM). Generally, such truncation can be of 1, 2, 3, 4, 5, 6, 7, 8, 9 or 10 amino acid residues.

Alternatively, modified DP107 and DP178 peptides with reduced binding affinity may be identified and generated by identifying and substituting, inserting or deleting amino acid residues. For example in one embodiment, which is also demonstrated in the example presented below in Section 30, modified DP107 and/or DP178 peptides may be routinely synthesized and assayed for reduced binding affinity by systematically replacing one or more amino acid residues of the native DP107 or DP178 peptide with other amino acid residues and testing the binding affinity of the resulting peptide by techniques such as those described herein. Preferably, the substituted amino acid residues are neutral amino acid residues exhibiting relatively small side chains, such as alanine or glycine.

Such substitutions can identify "key" amino acid residues and can be used in the competition assays of the invention. Alternatively, upon identification of key residues by such systematic substitutions, the key residues can be changed to other residues and the resulting, modified peptides can be tested for binding affinity.

Modified DP107 and/or DP178 peptides that have reduced binding affinities may still further be identified using principles of protein chemistry and design that are well known to those of skill in the art. Specifically, such principles may be used to identify those amino acid residues of a native DP107 or DP178 sequence that effect, e.g., solubility, binding affinity, or stability of the peptide. Thus, for example, using known principles of amino acid chemistry and protein design one skilled in the art could identify amino acid residues in a native DP107 or DP178 peptide that affect the structure of the peptide.

5.7. Pharmaceutical Formulations Dosages and Modes of Administration

The peptides of the invention may be administered using techniques well known to those in the art. Preferably, agents are formulated and administered systemically. Techniques for formulation and administration may be found in "Remington's Pharmaceutical Sciences", 18th ed., 1990, Mack Publishing Co., Easton, Pa. Suitable routes may include oral, rectal, transmucosal, or intestinal administration; parenteral delivery, including intramuscular, subcutaneous, intramedullary injections, as well as, intrathecal, direct intraventricular, intravenous, intraperitoneal, intranasal, or intraocular injections, just to name a few. For injection, the agents of the invention may be formulated in aqueous solutions, preferably in physiologically compatible buffers such as Hanks' solution, Ringer's solution, or physiological saline buffer. For such transmucosal administration, penetrants appropriate to the barrier to be permeated are used in the formulation. Such penetrants are generally known in the art.

In instances wherein intracellular administration of the peptides of the invention or other inhibitory agents is preferred, techniques well known to those of ordinary skill in the art may be utilized. For example, such agents may be encapsulated into liposomes, then administered as described above. Liposomes are spherical lipid bilayers with aqueous interiors. All molecules present in an aqueous solution at the time of liposome formation are incorporated into the aqueous interior. The liposomal contents are both protected from the external microenvironment and, because liposomes fuse with cell membranes, are effectively delivered into the cell cytoplasm. Additionally, due to their hydrophobicity, when small molecules are to be administered, direct intracellular administration may be achieved.

Nucleotide sequences encoding the peptides of the invention which are to be intracellularly administered may be expressed in cells of interest, using techniques well known to those of skill in the art. For example, expression vectors derived from viruses such as retroviruses, vaccinia viruses, adeno-associated viruses, herpes viruses, or bovine papilloma viruses, may be used for delivery and expression of such nucleotide sequences into the targeted cell population. Methods for the construction of such vectors and expression constructs are well known. See, for example, Sambrook et al., 1989, Molecular Cloning, A Laboratory Manual, Cold Spring Harbor Press, Cold Spring Harbor N.Y., and Ausubel et al., 1989, Current Protocols in Molecular Biology, Greene Publishing Associates and Wiley Interscience, NY.

With respect to HIV, peptides of the invention, particularly DP107 and DP178, may be used as therapeutics in the treatment of AIDS. In addition, the peptides may be used as prophylactic measures in previously uninfected individuals after acute exposure to an HIV virus. Examples of such prophylactic use of the peptides may include, but are not limited to, prevention of virus transmission from mother to infant and other settings where the likelihood of HIV transmission exists, such as, for example, accidents in health care settings wherein workers are exposed to HIV-containing blood products. The successful use of such treatments do not rely upon the generation of a host immune response directed against such peptides.

Effective dosages of the peptides of the invention to be administered may be determined through procedures well known to those in the art which address such parameters as biological half-life, bioavailability, and toxicity. Given the data presented below in Section 6, DP178, for example, may prove efficacious in vivo at doses required to achieve circulating levels of about 1 to about 10 ng per ml of peptide.

A therapeutically effective dose refers to that amount of the compound sufficient to result in amelioration of symptoms or a prolongation of survival in a patient. Toxicity and therapeutic efficacy of such compounds can be determined by standard pharmaceutical procedures in cell cultures or experimental animals, e.g., for determining the $LD_{50}$ (the dose lethal to 50% of the population) and the ED50 (the dose therapeutically effective in 50% of the population). The dose ratio between toxic and therapeutic effects is the therapeutic index and it can be expressed as the ratio $LD_{50}/ED_{50}$. Compounds which exhibit large therapeutic indices are preferred. The data obtained from these cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the $IC_{50}$ (e.g., the concentration of the test compound which achieves a half-maximal inhibition of the fusogenic event, such as a half-maximal inhibition of viral infection relative to the amount of the event in the absence of the test compound) as determined in cell culture. Such information can be used to more accurately determine useful doses in humans. Levels in plasma may be measured, for example, by high performance liquid chromatography (HPLC).

The peptides of the invention may, further, serve the role of a prophylactic vaccine, wherein the host raises antibodies against the peptides of the invention, which then serve to neutralize HIV viruses by, for example, inhibiting further HIV infection. Administration of the peptides of the invention as a prophylactic vaccine, therefore, would comprise administering to a host a concentration of peptides effective in raising an immune response which is sufficient to neutralize HIV, by, for example, inhibiting HIV ability to infect cells.

The exact concentration will depend upon the specific peptide to be administered, but may be determined by using standard techniques for assaying the development of an immune response which are well known to those of ordinary skill in the art. The peptides to be used as vaccines are usually administered intramuscularly.

The peptides may be formulated with a suitable adjuvant in order to enhance the immunological response. Such adjuvants may include, but are not limited to mineral gels such as aluminum hydroxide; surface active substances such as lysolecithin, pluronic polyols, polyanions; other peptides; oil emulsions; and potentially useful human adjuvants such as BCG and Corynebacterium parvum. Many methods may be used to introduce the vaccine formulations described here. These methods include but are not limited to oral, intradermal, intramuscular, intraperitoneal, intravenous, subcutaneous, and intranasal routes.

Alternatively, an effective concentration of polyclonal or monoclonal antibodies raised against the peptides of the invention may be administered to a host so that no uninfected cells become infected by HIV. The exact concentration of such antibodies will vary according to each specific antibody preparation, but may be determined using standard techniques well known to those of ordinary skill in the art. Administration of the antibodies may be accomplished using a variety of techniques, including, but not limited to those described in this section.

For all such treatments described above, the exact formulation, route of administration and dosage can be chosen by the individual physician in view of the patient's condition. (See e.g. Fingl et al., 1975, in "The Pharmacological Basis of Therapeutics", Ch. 1 p1).

It should be noted that the attending physician would know how to and when to terminate, interrupt, or adjust administration due to toxicity, or to organ dysfunctions. Conversely, the attending physician would also know to adjust treatment to higher levels if the clinical response were not adequate (precluding toxicity). The magnitude of an administrated dose in the management of the oncogenic disorder of interest will vary with the severity of the condition to be treated and the route of administration. The dose and perhaps dose frequency, will also vary according to the age, body weight, and response of the individual patient. A program comparable to that discussed above may be used in veterinary medicine.

Use of pharmaceutically acceptable carriers to formulate the compounds herein disclosed for the practice of the invention into dosages suitable for systemic administration is within the scope of the invention. With proper choice of carrier and suitable manufacturing practice, the compositions of the present invention, in particular, those formulated as solutions, may be administered parenterally, such as by intravenous injection. The compounds can be formulated readily using pharmaceutically acceptable carriers well known in the art into dosages suitable for oral administration. Such carriers enable the compounds of the invention to be formulated as tablets, pills, capsules, liquids, gels, syrups, slurries, suspensions and the like, for oral ingestion by a patient to be treated.

Pharmaceutical compositions suitable for use in the present invention include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of the active compounds into preparations which can be used pharmaceutically. The preparations formulated for oral administration may be in the form of tablets, dragees, capsules, or solutions.

The pharmaceutical compositions of the present invention may be manufactured in a manner that is itself known, e.g., by means of conventional mixing, dissolving, granulating, dragee-making, levigating, emulsifying, encapsulating, entrapping or lyophilizing processes.

Pharmaceutical formulations for parenteral administration include aqueous solutions of the active compounds in water-soluble form. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Aqueous injection suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Pharmaceutical preparations for oral use can be obtained by combining the active compounds with solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents may be added, such as the cross-linked polyvinyl pyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to the tablets or dragee coatings for identification or to characterize different combinations of active compound doses.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added.

6. EXAMPLES: DP178 IS A POTENT INHIBITOR OF HIV-1 INFECTION

In this example, DP178 (SEQ ID NO:15) is shown to be a potent inhibitor of HIV-1 mediated CD-4$^+$ cell-cell fusion and infection by cell-free virus. In the fusion assay, this peptide completely blocks virus-induced syncytia formation at concentrations of from 1–10 ng/ml. In the infectivity assay the inhibitory concentration is somewhat higher, blocking infection at 90 ng/ml. It is further shown that DP178 (SEQ ID NO:15) shows that the antiviral activity of DP178 (SEQ ID NO:15) is highly specific for HIV-1. Additionally, a synthetic peptide, DP-185 (SEQ ID NO:1357), representing a HIV-1-derived DP178 homolog is also found to block HIV-1-mediated syncytia formation.

6.1. Materials and Methods

Peptide Synthesis:

Peptides were synthesized using Fast Moc chemistry on an Applied Biosystems Model 431A peptide synthesizer. Generally, unless otherwise noted, the peptides contained amidated carboxy termini and acetylated amino termini. Amidated peptides were prepared using Rink resin (Advanced Chemtech) while peptides containing free carboxy termini were synthesized on Wang (p-alkoxy-benzyl-alcohol) resin (Bachem). First residues were double coupled to the appropriate resin and subsequent residues were single coupled. Each coupling step was followed by acetic anhydride capping. Peptides were cleaved from the resin by treatment with trifluoracetic acid (TFA) (10 ml), H$_2$O (0.5 ml), thioanisole (0.5 ml), ethanedithiol (0.25 ml), and crystalline phenol (0.75 g). Purification was carried out by reverse phase HPLC. Approximately 50 mg samples of crude peptide were chromatographed on a Waters Delta Pak C18 column (19 mm×30 cm, 15$\mu$ spherical) with a linear gradient; H$_2$O/acetonitrile 0.1% TFA. Lyophilized peptides were stored desiccated and peptide solutions were made in water at about 1 mg/ml. Electrospray mass spectrometry yielded the following results: DP178 (SEQ ID NO:15): 4491.87 (calculated 4491.94); DP-180 (SEQ ID NO:55): 4491.45 (calculated 4491.94); DP-185 (SEQ ID NO:1357): not done (calculated 4546.97).

Virus:

The HIV-1$_{LAI}$ virus was obtained from R. Gallo (Popovic, M. et al., 1984, Science 224:497–508) and propagated in CEM cells cultured in RPMI 1640 containing 10% fetal calf serum. Supernatant from the infected CEM cells was passed through a 0.2 cm filter and the infectious titer estimated in a microinfectivity assay using the AA5 cell line to support virus replication. For this purpose, 25 $\mu$l of serial diluted virus was added to 75 $\mu$l AA5 cells at a concentration of 2×10$^5$/ml in a 96-well microtitre plate. Each virus dilution was tested in triplicate. Cells were cultured for eight days by addition of fresh medium every other day. On day 8 post infection, supernatant samples were tested for virus replication as evidenced by reverse transcriptase activity released to the supernatant. The TCID$_{50}$ was calculated according to the Reed and Muench formula (Reed, L. J. et al., 1938, Am. J. Hyg. 27:493–497). The titer of the HIV-1$_{LAI}$ and HIV-1$_{MN}$ stocks used for these studies, as measured on the AA5 cell line, was approximately 1.4×10$^6$ and 3.8×10$^4$ TCID$_{50}$/ml, respectively.

Cell Fusion Assay:

Approximately 7×10$^4$ Molt cells were incubated with 1×10$^4$ CEM cells chronically infected with the HIV-1$_{LAI}$ virus in 96-well plates (one-half area cluster plates; Costar, Cambridge, Mass.) in a final volume of 100 $\mu$l culture medium as previously described (Matthews, T. J. et al., 1987, Proc. Natl. Acad. Sci. USA 84: 5424–5428). Peptide inhibitors were added in a volume of 10 $\mu$l and the cell mixtures were incubated for 24 hr. at 37° C. At that time, multinucleated giant cells were estimated by microscopic examination at a 40× magnification which allowed visualization of the entire well in a single field.

Cell Free Virus Infection Assay:

Synthetic peptides were incubated at 37° C. with either 247 $TCID_{50}$ (for experiment depicted in FIG. 2), or 62 $TCID_{50}$ (for experiment depicted in FIG. 3) units of HIV-$1_{LAI}$ virus or 25 $TCID_{50}$ units of HIV-$2^{NIHZ}$ and CEM $CD4^+$ cells at peptide concentrations of 0, 0.04, 0.4, 4.0, and 40 μg/ml for 7 days. The resulting reverse transcriptase (RT) activity in counts per minute was determined using the assay described, below, in Section 6.1.5. See, Reed, L. J. et al., 1938, Am. J. Hyg. 27: 493–497 for an explanation of $TCID_{50}$ calculations.

Reverse Transcriptase Assay:

The micro-reverse transcriptase (RT) assay was adapted from Goff et al. (Goff, S. et al., 1981, J. Virol. 38:239–248) and Willey et al. (Willey, R. et al., 1988, J. Virol. 62:139–147). Supernatants from virus/cell cultures are adjusted to 1% Triton-X100. A 10 μl sample of supernatant was added to 50 μl of RT cocktail in a 96-well U-bottom microtitre plate and the samples incubated at 37° C. for 90 min. The RT cocktail contained 75 mM KCl, 2 mM dithiothreitol, 5 mM $MgCl_2$, 5 μg/ml poly A (Pharmacia, cat. No. 27-4110-01), 0.25 units/ml oligo dT (Pharmacia, cat. No. 27-7858-01), 0.05% NP40, 50 mM Tris-HCl, pH 7.8, 0.5 μM non-radioactive dTTP, and 10 μCi/ml $^{32}P$-dTTP (Amersham, cat. No. PB. 10167).

After the incubation period, 40 μl of reaction mixture was applied to a Schleicher and Schuell (S+S) NA45 membrane (or DE81 paper) saturated in 2×SSC buffer (0.3 M NaCl and 0.003 M sodium citrate) held in a S+S Minifold over one sheet of GB003 (S+S) filter paper, with partial vacuum applied. Each well of the minifold was washed four times with 200 μl 2×SSC, under full vacuum. The membrane was removed from the minifold and washed 2 more times in a pyrex dish with an excess of 2×SSC. Finally, the membrane was drained on absorbent paper, placed on Whatman #3 paper, covered with Saran wrap, and exposed to film overnight at −70° C.

6.2. Results

Peptide Inhibition of Infected Cell-Induced Syncytia Formation:

The initial screen for antiviral activity assayed peptides' ability to block syncytium formation induced by overnight co-cultivation of uninfected Molt 4 cells with chronically HIV-1 infected CEM cells. The results of several such experiments are presented herein. In the first of these experiments, serial DP178 (SEQ ID NO:15) peptide concentrations between 10 μg/ml and 12.5 ng/ml were tested for blockade of the cell fusion process. For these experiments, CEM cells chronically infected with either HIV-$1_{LAI}$, HIV-$1_{MN}$, HIV-$1_{RF}$, or HIV-$1_{SF2}$ virus were cocultivated overnight with uninfected Molt 4 cells. The results (FIGS. 4A–4B) show that DP178 (SEQ ID NO:15) afforded complete protection against each of the HIV-1 isolates down to the lowest concentration of DP178 (SEQ ID NO:15) used. For $HIV_{LAI}$ inhibition, the lowest concentration tested was 12.5 ng/ml; for all other HIV-1 viruses, the lowest concentration of DP178 (SEQ ID NO:15) used in this study was 100 ng/ml. A second peptide, DP-180 (SEQ ID NO:55), containing the same amino acid residues as DP178 (SEQ ID NO:15), but arranged in a random order, exhibited no evidence of anti-fusogenic activity even at the high concentration of 40 μg/ml (FIG. 4B). These observations indicate that the inhibitory effect of DP178 (SEQ ID NO:15) is primary sequence-specific and not related to non-specific peptide/protein interactions. The actual endpoint (i.e., the lowest effective inhibitory concentration) of DP178 inhibitory action is within the range of 1–10 ng/ml.

The next series of experiments involved the preparation and testing of a DP178 (SEQ ID NO:15) homolog for its ability to inhibit HIV-1-induced syncytia formation. As shown in FIG. 1, the sequence of DP-185 (SEQ ID NO:1357) is slightly different from DP178 (SEQ ID NO:15) in that its primary sequence is taken from the HIV-$1_{SF2}$ isolate and contains several amino acid differences compared to DP178 (SEQ ID NO:15) near the N terminus. As shown in FIG. 4B, DP-185 (SEQ ID NO:1357) exhibits inhibitory activity even at 312.5 ng/ml, the lowest concentration tested.

The next series of experiments involved a comparison of DP178 (SEQ ID NO:15) HIV-1 and HIV-2 inhibitory activity. As shown in FIG. 5, DP178 (SEQ ID NO:15) blocked HIV-1-mediated syncytia formation at peptide concentrations below 1 ng/ml. DP178 (SEQ ID NO:15) failed, however, to block HIV-2 mediated syncytia formation at concentrations as high as 10 μg/ml. This striking 4 log selectivity of DP178 (SEQ ID NO:15) as an inhibitor of HIV-1-mediated cell fusion demonstrates an unexpected HIV-1 specificity in the action of DP178 (SEQ ID NO:15). DP178 (SEQ ID NO:15) inhibition of HIV-1-mediated cell fusion, contrasted with the peptide's inability to inhibit HIV-2 medicated cell fusion in the same cell type at the concentrations tested provides further evidence for the high degree of selectivity associated with the antiviral action of DP178 (SEQ ID NO:15).

Peptide Inhibition of Infection By Cell-Free Virus:

DP178 (SEQ ID NO:15) was next tested for its ability to block $CD-4^+$ CEM cell infection by cell-free HIV-1 virus. The results, shown in FIG. 2, are from an experiment in which DP178 (SEQ ID NO:15) was assayed for its ability to block infection of CEM cells by an HIV-$1_{LAI}$ isolate. Included in the experiment were three control peptides, DP-116 (SEQ ID NO:1552), DP-125 (SEQ ID NO:496), and DP-118 (SEQ ID NO:904). DP-116 (SEQ ID NO:1552) represents a peptide previously shown to be inactive using this assay, and DP-125 (SEQ ID NO:496; Wild, C. et al., 1992, Proc. Natl. Acad, Sci. USA 89:10,537) and DP-118 (SEQ ID NO:904) are peptides which have previously been shown to be active in this assay. Each concentration (0, 0.04, 0.4, 4, and 40 μg/ml) of peptide was incubated with 247 $TCID_{50}$ units of HIV-$1_{LAI}$ virus and CEM cells. After 7 days of culture, cell-free supernatant was tested for the presence of RT activity as a measure of successful infection. The results, shown in FIG. 2, demonstrate that DP178 (SEQ ID NO:15) inhibited the de novo infection process mediated by the HIV-1 viral isolate at concentrations as low as 90 ng/ml ($IC_{50}$=90 ng/ml). In contrast, the two positive control peptides, DP-125 (SEQ ID NO:496) and DP-118 (SEQ ID NO:904), had over 60-fold higher $IC_{50}$ concentrations of approximately 5 μg/ml.

In a separate experiment, the HIV-1 and HIV-2 inhibitory action of DP178 (SEQ ID NO:15) was tested with CEM cells and either HIV-$1_{LAI}$ or HIV-$2_{NIHZ}$. 62 $TCID_{50}$ HIV-$1_{LAI}$ or 25 $GCID_{50}$ HIV-$2_{NIHZ}$ were used in these experiments, and were incubated for 7 days. As may be seen in FIG. 3, DP178 (SEQ ID NO:15) inhibited HIV-1 infection with an $IC_{50}$ of about 31 ng/ml. In contrast, DP178 (SEQ ID NO:15) exhibited a much higher $IC_{50}$ for HIV-$2_{NHIZ}$, thus making DP178 (SEQ ID NO:15) two logs more potent as an HIV-1 inhibitor than as an HIV-2 inhibitor. This finding is consistent with the results of the fusion inhibition assays described, above, in Section 6.2.1, and further supports a significant level of selectivity (i.e., for HIV-1 over HIV-2).

7. EXAMPLE: THE HIV-1 INHIBITOR DP178 IS NON-CYTOTOXIC

In this Example, the 36 amino acid synthetic peptide inhibitor DP178 (SEQ ID NO:15) is shown to be non-cytotoxic to cells in culture, even at the highest peptide concentrations (40 µg/ml) tested.

7.1. Materials and Methods

Cell proliferation and toxicity assay: Approximately 3.8× $10^5$ CEM cells for each peptide concentration were incubated for 3 days at 37° C. in T25 flasks. Peptides tested were DP178 (SEQ ID NO:15) and DP-116 (SEQ ID NO:1552), as described in FIG. 1. Peptides were synthesized as described, above, in Section 6.1. The concentrations of each peptide used were 0, 2.5, 10, and 40 µg/ml. Cell counts were taken at incubation times of 0, 24, 48, and 72 hours.

7.2. Results

Whether the potent HIV-1 inhibitor DP178 (SEQ ID NO:15) exhibited any cytotoxic effects was assessed by assaying the peptide's effects on the proliferation and viability of cells in culture. CEM cells were incubated in the presence of varying concentrations of DP178 (SEQ ID NO:15), and DP-116 (SEQ ID NO:1552), a peptide previously shown to be ineffective as an HIV inhibitor (Wild, C. et al., 1992, Proc. Natl. Acad. Sci. USA 89:10,537–10,541). Additionally, cells were incubated in the absence of either peptide.

The results of the cytotoxicity study demonstrate that DP178 (SEQ ID NO: 15) exhibits no cytotoxic effects on cells in culture. As can be seen, below, in Table VI, even the proliferation and viability characteristics of cells cultured for 3 days in the presence of the highest concentration of DP178 (SEQ ID NO:15) tested (40 µg/ml) do not significantly differ from the DP-116 (SEQ ID NO:1552) or the no-peptide controls. The cell proliferation data is also represented in graphic form in FIG. 6. As was demonstrated in the Working Example presented above in Section 6, DP178 (SEQ ID NO:15) completely inhibits HIV-1 mediated syncytia formation at peptide concentrations between 1 and 10 ng/ml, and completely inhibits cell-free viral infection at concentrations of at least 90 ng/ml. Thus, this study demonstrates that even at peptide concentrations greater than 3 log higher than the HIV inhibitory dose, DP178 (SEQ ID NO:15) exhibits no cytotoxic effects.

TABLE VI

| Peptide | Concentration µg/ml | % Viability at time (hours) | | | |
|---|---|---|---|---|---|
| | | 0 | 24 | 48 | 72 |
| DP178 (SEQ ID NO:15) | 40 | 98 | 97 | 95 | 97 |
| | 10 | 98 | 97 | 98 | 98 |
| | 2.5 | 98 | 93 | 96 | 96 |
| DP116 (SEQ ID NO:1552) | 40 | 98 | 95 | 98 | 97 |
| | 10 | 98 | 95 | 93 | 98 |
| | 2.5 | 98 | 96 | 98 | 99 |
| No Peptide | 0 | 98 | 97 | 99 | 98 |

8. EXAMPLE: THE INTERACTION OF DP178 AND DP107

Soluble recombinant forms of gp41 used in the example described below provide evidence that the DP178 peptide associates with a distal site on gp41 whose interactive structure is influenced by the DP107 leucine zipper motif. A single mutation disrupting the coiled-coil structure of the leucine zipper domain transformed the soluble recombinant gp41 protein from an inactive to an active inhibitor of HIV-1 fusion. This transformation may result from liberation of the potent DP178 domain from a molecular clasp with the leucine zipper, DP107, determinant. The results also indicate that the anti-HIV activity of various gp41 derivatives (peptides and recombinant proteins) may be due to their ability to form complexes with viral gp41 and interfere with its fusogenic process.

8.1. Materials and Methods

Construction of Fusion Proteins and gp41 Mutants:

Construction of fusion proteins and mutants shown in FIG. 7 was accomplished as follows: the DNA sequence corresponding to the extracellular domain of gp41 (540–686) was cloned into the Xmn I site of the expression vector pMal-p2 (New England Biolab) to give M41. The gp41 sequence was amplified from pgtat (Malim et al., 1988, Nature 355: 181–183) by using polymerase chain reaction (PCR) with upstream primer 5'-ATGACGCTG ACGGTACAGGCC-3' (primer A, SEQ ID NO:1902) and downstream primer 5'-TGACTAAGCTTAATA CCACAGCCAATTTGTTAT-3' (primer B, SEQ ID NO:1903). M41-P was constructed by using the T7-Gen in vitro mutagenesis kit from United States Biochemicals (USB) following the supplier's instructions. The mutagenic primer (5'-GGAGCTGCTTGGGGCCCCAGAC-3') (SEQ ID NO:1906) introduces an Ile to Pro mutation in M41 at position 578. M41Δ107, from which the DP-107 region has been deleted, was made using a deletion mutagenic primer 5'-CCAAATCCCCAGGAGCTGCTCGAGCTGCACTAT ACCAGAC-3' (primer C, SEQ ID NO:1904) following the USB T7-Gen mutagenesis protocol. M41Δ178, from which the DP-178 region has been deleted, was made by cloning the DNA fragment corresponding to gp41 amino acids 540–642 into the Xmn I site of pMal-p2. Primer A and primer D (5'-ATAGCTTCTAGATTAATTGTTAATTTCTC TGTCCC-3') (SEQ ID NO:1905) were used in the PCR with the template pgtat to generate the inserted DNA fragments. M41-P was used as the template with primer A and D in PCR to generate M41-PΔ178. All inserted sequences and mutated residues were checked by restriction enzyme analysis and confirmed by DNA sequencing.

Purification and Characterization of Fusion Proteins:

The fusion proteins were purified according to the protocol described in the manufacturer's brochure of protein fusion and purification systems from New England Biolabs (NEB). Fusion proteins (10 ng) were analyzed by electrophoresis on 8% SDS polyacrylamide gels. Western blotting analysis was performed as described by Sambrook et al., 1989, Molecular Cloning: A Laboratory Manual, 2d Ed, Cold Spring Harbor Laboratory Press, Cold Spring Harbor, N.Y., Ch. 18, pp. 64–75. An HIV-1 positive serum diluted 1000-fold, or a human Fab derived from repertoire cloning was used to react with the fusion proteins. The second antibody was HRP-conjugated goat antihuman Fab. An ECL Western blotting detection system (Amersham) was used to detect the bound antibody. A detailed protocol for this detection system was provided by the manufacturer. Rainbow molecular weight markers (Amersham) were used to estimate the size of fusion proteins.

Cell Fusion Assays For Anti-HIV Activity:

Cell fusion assays were performed as previously described (Matthews et al., 1987, Proc. Natl. Acad. Sci. USA 84: 5424–5481). CEM cells (7×$10^4$) were incubated with HIV-1$_{IIIB}$ chronically infected CEM cells ($10^4$) in 96-well flat-bottomed half-area plates (Costar) in 100 µl culture medium. Peptide and fusion proteins at various concentrations in 10 µl culture medium were incubated with the cell mixtures at 37° C. for 24 hours. Multinucleated syncytia were estimated with microscopic examination. Both M41 and M41-P did not show cytotoxicity at the concentrations tested and shown in FIG. 8.

Inhibition of HIV-1 induced cell-cell fusion activity was carried out in the presence of 10 nM DP178 and various concentrations of M41Δ178 or M41-PΔ178 as indicated in FIG. 9. There was no observable syncytia in the presence of 10 nM DP178. No peptide or fusion protein was added in the control samples.

ELISA Analysis of DP178 Binding to the Leucine Zipper Motif of gp41:

The amino acid sequence of DP178 used is:

Y T S L I H S L I E E S Q N Q Q E K N E Q E L L E L D K W A S L W N W F (SEQ ID NO:15).

For enzyme linked immunoassay (ELISA), M41Δ178 or M41-PΔ178 (5 µg/ml) in 0.1 M NaHCO$_3$, pH 8.6, were coated on 96 well Linbro ELISA plates (Flow Lab, Inc.) overnight. Each well was washed three times with distilled water then blocked with 3% bovine serum albumin (BSA) for 2 hours. After blocking, peptides with 0.5% BSA in TBST (40 mM Tris-HCl pH7.5, 150 mM NaCl, 0.05% Tween 20) were added to the ELISA plates and incubated at room temperature for 1 hour. After washing three times with TBST, Fab-d was added at a concentration of 10 ng/ml with 0.5% BSA in TBST. The plates were washed three times with TBST after incubation at room temperature for 1 hour. Horseradish peroxidase (HRP) conjugated goat antihuman Fab antiserum at a 2000 fold dilution in TBST with 0.5% BSA was added to each well and incubated at room temperature for 45 minutes. The plates were then washed four times with TBST. The peroxidase substrate o-phenylene diamine (2.5 mg/ml) and 0.15% H$_2$O$_2$ were added to develop the color. The reaction was stopped with an equal volume of 4.5 N H$_2$SO$_4$ after incubation at room temperature for 10 minutes. The optical density of the stopped reaction mixture was measured with a micro plate reader (Molecular Design) at 490 nm. Results are shown in FIG. 10.

8.2. Results

Expression and Characterization of the Ectodomain of gp41:

As a step toward understanding the roles of the two helical regions in gp41 structure and function, the ectodomain of gp41 was expressed as a maltose binding fusion protein (M41) (FIG. 7). The fusogenic peptide sequence at the N-terminal of gp41 was omitted from this recombinant protein and its derivatives to improve solubility. The maltose binding protein facilitated purification of the fusion proteins under relatively mild, non-denaturing conditions. Because the M41 soluble recombinant gp41 was not glycosylated, lacked several regions of the transmembrane protein (i.e., the fusion peptide, the membrane spanning, and the cytoplasmic domains), and was expressed in the absence of gp120, it was not expected to precisely reflect the structure of native gp41 on HIV-1 virions. Nevertheless, purified M41 folded in a manner that preserved certain discontinuous epitopes as evidenced by reactivity with human monoclonal antibodies, 98–6, 126–6, and 50–69, previously shown to bind conformational epitopes on native gp41 expressed in eukaryotic cells (Xu et al., 1991, J. Virol. 65: 4832–4838; Chen, 1994, J. Virol. 68:2002–2010). Thus, at least certain regions of native gp41 defined by these antibodies appear to be reproduced in the recombinant fusion protein M41. Furthermore, M41 reacted with a human recombinant Fab (Fab-d) that recognizes a conformational epitope on gp41 and binds HIV-1 virions as well as HIV-1 infected cells but not uninfected cells as analyzed by FACS. Deletion of either helix motif, i.e. DP107 or DP178, of the M41 fusion protein eliminated reactivity with Fab-d. These results indicate that both helical regions, separated by 60 amino acids in the primary sequence, are required to maintain the Fab-d epitope.

Anti-HIV Activity of the Recombinant Ectodomain of HIV gp41:

The wild type M41 fusion protein was tested for anti-HIV-1 activity. As explained, supra, synthetic peptides corresponding to the leucine zipper (DP107) and the C-terminal putative helix (DP178) show potent anti-HIV activity. Despite inclusion of both these regions, the recombinant M41 protein did not affect HIV-1 induced membrane fusion at concentrations as high as 50 µM (Table VII, below).

TABLE VII

DISRUPTION OF THE LEUCINE ZIPPER OF GP41 FREES THE ANTI-HIV MOTIF

| | DP107 | DP178 | M41 | M41-P | M41-PΔ178 |
|---|---|---|---|---|---|
| Cell Fusion (IC$_{90}$) | 1 µM | 1 nM | >50 µM | 83 nM | >50 µM |
| Fab-D Binding (k$_D$) | — | — | 3.5 × 10$^{-9}$ | 2.5 × 10$^{-8}$ | — |
| HIV-infectivity (IC$_{90}$) | 1 µM | 80 nM | >16 nM | 66 nM | >8 µM |

Surprisingly, a single amino acid substitution, proline in place of isoleucine in the middle of the leucine zipper motif, yielded a fusion protein (M41-P) which did exhibit antiviral activity (Table VII and FIG. 8). As seen in Table VII, M41-P blocked syncytia formation by 90% at approximately 85 nM and neutralized HIV-1$_{IIIB}$ infection by 90% at approximately 70 nM concentrations. The anti-HIV-1 activity of M41-P appeared to be mediated by the C-terminal helical sequence since deletion of that region from M41-P yielded an inactive fusion protein, M41-PΔ178 (Table VII). This interpretation was reinforced by experiments demonstrating that a truncated fusion protein lacking the DP178 sequence, M41Δ178, abrogated the potent anti-fusion activity of the DP178 peptide in a concentration-dependent manner (FIG. 9). The same truncated fusion protein containing the proline mutation disrupting the leucine zipper, M41-PΔ178, was not active in similar competition experiments (FIG. 9). The results indicate that the DP178 peptide associates with a second site on gp41 whose interactive structure is dependent on a wild type leucine zipper sequence. A similar interaction may occur within the wild type fusion protein, M41, and act to form an intramolecular clasp which sequesters the DP178 region, making it unavailable for anti-viral activity.

A specific association between these two domains is also indicated by other human monoclonal Fab-d studies. For example, Fab-d failed to bind either the DP178 peptide or the fusion protein M41Δ178, but its epitope was reconstituted by simply mixing these two reagents together (FIG. 10). Again, the proline mutation in the leucine zipper domain of the fusion protein, M41-PΔ178, failed to reconstitute the epitope in similar mixing experiments.

9. EXAMPLE: METHOD FOR COMPUTER-ASSISTED IDENTIFICATION OF DP107-LIKE AND DP178-LIKE SEQUENCES

A number of known coiled-coil sequences have been well described in the literature and contain heptad repeat positioning for each amino acid. Coiled-coil nomenclature labels each of seven amino acids of a heptad repeat A through G, with amino acids A and D tending to be hydrophobic positions. Amino acids E and G tend to be charged. These four positions (A, D, E, and G) form the amphipathic backbone structure of a monomeric alpha-helix. The backbones of two or more amphipathic helices interact with each other to form di-, tri-, tetrameric, etc., coiled-coil structures. In order to begin to design computer search motifs, a series of well characterized coiled coils were chosen including yeast transcription factor GCN4, Influenza Virus hemagglutinin loop 36, and human proto-oncogenes c-Myc, c-Fos, and c-Jun. For each peptide sequence, a strict homology for the A and D positions, and a list of the amino acids which could be excluded for the B, C, E, F, and G positions (because they are not observed in these positions) was determined. Motifs were tailored to the DP107 and DP178 sequences by deducing the most likely possibilities for heptad positioning of the amino acids of HIV-1 Bru DP-107, which is known to have coiled-coil structure, and HIV-1 Bru DP178, which is still structurally undefined. The analysis of each of the sequences is contained in FIG. 12. For example, the motif for GCN4 was designed as follows:

1. The only amino acids (using standard single letter amino acid codes) found in the A or D positions of GCN4 were [LMNV].
2. All amino acids were found at B, C, E, F, and G positions except {CFGIMPTW}.
3. The PESEARCH motif would, therefore, be written as follows:
   [LMNV]-{CFGIMPTW}(2)-[LMNV]-{CFGIMPTW}(3)-
   [LMNV]-{CFGIMPTW}(2)-[LMNV]-{CFGIMPTW}(3)-
   [LMNV]-{CFGIMPTW}(2)-[LMNV]-{CFGIMPTW}(3)-
   [LMNV]-{CFGIMPTW}(2)-[LMNV]-{CFGIMPTW}(3)

Translating or reading the motif: "at the first A position either L, M, N, or V must occur; at positions B and C (the next two positions) accept everything except C, F, G, I, M, P, T, or W; at the D position either L, M, N, or V must occur; at positions E, F, and G (the next 3 positions) accept everything except C, F, G, I, M, P, T, or W." This statement is contained four times in a 28-mer motif and five times in a 35-mer motif. The basic motif key then would be: [LMNV]-{CFGIMPTW}. The motif keys for the remaining well described coiled-coil sequences are summarized in FIG. 12.

The motif design for DP107 and DP178 was slightly different than the 28-mer model sequences described above due to the fact that heptad repeat positions are not defined and the peptides are both longer than 28 residues. FIG. 13 illustrates several possible sequence alignments for both DP107 and DP178 and also includes motif designs based on 28-mer, 35-mer, and full-length peptides. Notice that only slight differences occur in the motifs as the peptides are lengthened. Generally, lengthening the base peptide results in a less stringent motif. This is very useful in broadening the possibilities for identifying DP107-or DP-178-like primary amino acid sequences referred to in this document as "hits".

In addition to making highly specific motifs for each type peptide sequence to be searched, it is also possible to make "hybrid" motifs. These motifs are made by "crossing" two or more very stringent motifs to make a new search algorithm which will find not only both "parent" motif sequences but also any peptide sequences which have similarities to one, the other, or both "parents". For example, in FIG. 14 the "parent" sequence of GCN4 is crossed with each of the possible "parent" motifs of DP-107. Now the hybrid motif must contain all of the amino acids found in the A and D positions of both parents, and exclude all of the amino acids not found in either parent at the other positions. The resulting hybrid from crossing GCN4 or [LMNV]{CFGIMPTW} and DP107 (28-mer with the first L in the D position) or [ILQT]{CDFIMPST}, is [ILMNQTV]{CFIMPT}. Notice that now only two basic hybrid motifs exist which cover both framing possibilities, as well as all peptide lengths of the parent DP-107 molecule. FIG. 15 represents the "hybridizations" of GCN4 with DP-178. FIG. 16 represents the "hybridizations" of DP107 and DP178. It is important to keep in mind that the represented motifs, both parent and hybrid, are motif keys and not the depiction of the full-length motif needed to actually do the computer search.

Hybridizations can be performed on any combination of two or more motifs. FIG. 17 summarizes several three-motif hybridizations including GCN4, DP107 (both frames), and DP178 (also both frames). Notice that the resulting motifs are now becoming much more similar to each other. In fact, the first and third hybrid motifs are actually subsets of the second and fourth hybrid motifs respectively. This means that the first and third hybrid motifs are slightly more stringent than the second and fourth. It should also be noted that with only minor changes in these four motifs, or by hybridizing them, a single motif could be obtained which would find all of the sequences. However, it should be remembered that stringency is also reduced. Finally, the most broad-spectrum and least-stringent hybrid motif is described in FIG. 18 which summarizes the hybridization of GCN4, DP107 (both frames), DP178 (both frames), c-Fos, c-Jun, c-Myc, and Flu loop 36.

A special set of motifs was designed based on the fact that DP-178 is located only approximately ten amino acids upstream of the transmembrane spanning region of gp41 and just C-terminal to a proline which separates DP107 and DP178. It has been postulated that DP178 may be an amphipathic helix when membrane associated, and that the proline might aid in the initiation of the helix formation. The same arrangement was observed in Respiratory Syncytial Virus; however, the DP178-like region in this virus also had a leucine zipper just C-terminal to the proline. Therefore, N-terminal proline-leucine zipper motifs were designed to analyze whether any other viruses might contain this same pattern. The motifs are summarized in FIG. 19.

10. EXAMPLE: COMPUTER-ASSISTED IDENTIFICATION OF DP107-LIKE AND DP178-LIKE SEQUENCES IN HUMAN RESPIRATORY SYNCYTIAL VIRUS

FIG. 20 represents search results for Human Respiratory Syncytial Virus (RSV; Strain A2) fusion glycoprotein F1 (PC/Gene protein sequence name PVGLF_HRSVA). Motif 107×178×4 finds three hits including amino acids 152–202, 213–243, and 488–515. The arrangement of these hits is similar to what is found in HIV-1 except that the motif finds two regions with similarities to DP-178, one just downstream of what would be called the DP107 region or amino acids 213–243, and one just upstream of the transmembrane region (also similar to DP178) or amino acids 488–515. Motif ALLMOTI5 also finds three areas including amino acids 116–202, 267–302, and 506–549. The proline-leucine zipper motifs also gave several hits including amino acids 205–221 and 265–287 (P1LZIPC 265–280, P12LZIPC), and 484–513 (P7LZIPC and P12LZIPC 484–506, P23LZIPC). Notice that the PLZIP motifs also identify regions which share location similarities with DP-178 of HIV-1.

11. EXAMPLE: CD AND ANTIVIRAL CHARACTERIZATION OF POTENTIAL RSV DP178 AND DP107 ANALOGS

In the Example presented herein, respiratory syncytial virus (RSV) peptides identified by utilizing the computer-assisted search motifs described in the Examples presented in Sections 9 and 10, above, were tested for anti-RSV activity. Additionally, circular dichroism (CD) structural analyses were conducted on the peptides, as discussed below. It is demonstrated that several of the identified peptides exhibit potent antiviral capability. Additionally, it is shown that several of these peptides exhibit a substantial helical character.

11.1. Materials and Methods

Structural Analysis:

The CD spectra were measured in a 10 mM sodium phosphate, 150 mM sodium chloride, pH 7.0, buffer at approximately 10 mM concentrations, using a 1 cm path length cell on a Jobin/Yvon Autodichrograph Mark V CD spectrophotometer. Peptides were synthesized according to the methods described, above, in Section 6.1. Peptide concentrations were determined from $A_{280}$ using Edlehoch's method (1967, Biochemistry 6:1948).

Anti-RSV Antiviral Activity Assays:

The assay utilized herein tested the ability of the peptides to disrupt the ability of HEp2 cells acutely infected with RSV (i.e., cells which are infected with a multiplicity of infection of greater than 2) to fuse and cause syncytial formation on a monolayer of uninfected an uninfected line of Hep-2 cells. The lower the observed level of fusion, the greater the antiviral activity of the peptide was determined to be.

Uninfected confluent monolayers of Hep-2 cells were grown in microtiter wells in 3% EMEM (Eagle Minimum Essential Medium w/o L-glutamine [Bio Whittaker Cat. No. 12-125F], with fetal bovine serum [FBS; which had been heat inactivated for 30 minutes at 56° C.; Bio Whittaker Cat. No. 14-501F) supplemented at 3%, antibiotics (penicillin/streptomycin; Bio Whittaker Cat. No. 17-602E) added at 1%, and glutamine added at 1%.

To prepare Hep2 cells for addition to uninfected cells, cultures of acutely infected Hep2 cells were washed with DPBS (Dulbecco's Phosphate Buffered Saline w/o calcium or magnesium; Bio Whittaker Cat. No. 17-512F) and cell monolayers were removed with Versene (1:5000; Gibco Life Technologies Cat. No. 15040-017). The cells were spun 10 minutes and resuspended in 3% FBS. Cell counts were performed using a hemacytometer. Persistent cells were added to the uninfected Hep-2 cells.

The antiviral assay was conducted by, first, removing all media from the wells containing uninfected Hep-2 cells, then adding peptides (at the dilutions described below) in 3% EMEM, and 100 acutely RSV-infected Hep2 cells per well. Wells were then incubated at 37° C. for 48 hours.

After incubation, cells in control wells were checked for fusion centers, media was removed from the wells, followed by addition, to each well, of either Crystal Violet stain or XTT. With respect to Crystal Violet, approximately 50 µl 0.25% Crystal Violet stain in methanol were added to each well. The wells were rinsed immediately, to remove excess stain, and were allowed to dry. The number of syncytia per well were then counted, using a dissecting microscope.

With respect to XTT (2,3-bis[2-Methoxy-4-nitro-5-sulfophenyl]-2H-tetrazolium-5-carboxyanilide inner salt), 50 µl XTT (1 mg/ml in RPMI buffered with 100 mM HEPES, pH 7.2–7.4, plus 5% DMSO) were added to each well. The $OD_{450/690}$ was measured (after blanking against growth medium without cells or reagents, and against reagents) according to standard procedures.

Peptides:

The peptides characterized in the study presented herein were:

Group 1) peptides T-142 to T-155 and T-575, as shown in FIGS. 21A–B; and peptides T-22 to T-27, T-68, T-334, T-371 to T-375, and T-575, as shown in FIG. 21C;

Group 2) peptides T-120 to T-141, as shown in FIGS. 21D–E; and peptides T-12, T-13, T-15, T-19, T-28 to T-30, T-66, T-69, T-70 and T-576, as shown in FIG. 21F; and Group 3) peptides T-67 and T-104 to T-119, as shown in FIGS. 22A–B; and peptides T-71, T-384, T-613 to T-617, T-662, T-665 to T-676, and T-730, as shown in FIG. 22C.

The peptides of group 1 represent portions of the RSV F2 protein DP178/107-like region. The peptides of group 2 represent portions of the RSV F1 protein DP107-like region. The peptides of groups 3 represent portions of the RSV F1 protein DP178-like region.

Each peptide was tested at 2-fold serial dilutions ranging from 100 µg/ml to approximately 100 ng/ml. For each of the assays, a well containing no peptide was also used. The $IC_{50}$ data for each peptide represents the average of several experiments conducted utilizing that peptide.

11.2. Results

The data summarized in FIGS. 21A–F and FIGS. 22A–C represent antiviral and structural information obtained from peptides derived from the RSV F2 DP178/DP107-like F2 region (FIGS. 21A–C), the RSV F1 DP-107-like region (FIGS. 21D–F), and the RSV DP178-like F2 region (FIGS. 22A–C).

As shown in FIGS. 21A–F, a number of the RSV DP178/DP107-like peptides exhibited a detectable level of antiviral activity. Peptides from the RSV DP178/DP107-like F2 region (FIGS. 21A–C), for example, T-142 to T-145 and T-334 purified peptides, exhibited detectable levels of antiviral activity, as evidenced by their $IC_{50}$ values. Further, a number of RSV F1 DP107-like peptides (FIGS. 21D–F) exhibited a sizable level of antiviral activity as purified peptides, including, for example, peptides T-124 to T-127, T-131, T-135 and T-137 to T-139, as demonstrated by their low $IC_{50}$ values. In addition, CD analysis FIGS. 21B, 21E) reveals that many of the peptides exhibit some detectable level of helical structure.

The results summarized in FIGS. 22A–C demonstrate that a number of DP178-like purified peptides exhibit a range of potent anti-viral activity. These peptides include, for example, T-67, T-104, T-105 and T-107 to T-119, as listed in FIGS. 22A–B, and T-665 to T-669 and T-671 to T-673, as listed in FIG. 22C. In addition, some of the DP178-like peptides exhibited some level of helicity.

Thus, the computer assisted searches described, hereinabove, successfully identified viral peptide domains that represent highly promising anti-RSV antiviral compounds.

12. EXAMPLE: IDENTIFICATION OF RSV DP107/DP178 ANALOGS WITH REDUCED BINDING AFFINITIES

In the example presented herein, peptides derived from the RSV DP178 analog T112 are described and tested for binding affinity to the DP107-like domain of the RSV F1-protein. Particular peptides are identified that have a reduced binding affinity for their DP107-like target, and key amino acid residues are identified the confer high binding affinity to the native peptide (i.e., to T112). Such peptides are useful, e.g., in screening assays such as those described above in Section 5.7.1 to identify compounds which inhibit or disrupt the interaction between DP107 and DP178, and in providing guidance for generation of additional peptides exhibiting reduced affinity binding.

12.1. Materials and Methods

A maltose binding fusion protein of the RSV F1-protein (MF5.1) was constructed using methods similar to those described in Section 8.1.2, supra, for construction of the M41 fusion protein. Specifically, the DNA sequence corresponding amino acid residues 142–302 of the RSV F1 protein was amplified by PCR and cloned into the Xmn I site of the expression vector pMal-p2 (New England Biolab) to give MF5.1. These amino acid residues correspond to the extracellular domain of the RSV F1 protein including its DP107 region but excluding the DP178 region.

The peptides characterized in the study presented herein were: T122, T800, T801, T802, T803, T804, T805, T806, T807, T808, T809, T810, T811, T1669, T1670, T16671, T1672, T1673, T1680, T1681, T1682, T1683 and T1684, as shown in FIG. 23. T112 represents the DP178-like region of the RSV F1 protein. The other peptides characterized are modified DP178 proteins derived from T112.

Cell fusion assays were performed with each of the peptides as described in Section 17 above. The binding affinity of each peptide was also measured in a competitive binding assay described in Section 5.7.1 above, wherein the concentration of each peptide necessary to bind to the M5.1 fusion protein (i.e., the $B_{50}$ value), and thereby disrupt binding of biotin labeled T112 (T888) to the fusion protein, was measured.

12.2. Results

T112 is a 35 amino acid residue peptide that corresponds to amino acid residues 482–516 of the RSV F1 protein and has the following amino acid sequence:

VFPSDEFDASISQVNEKINQSLAFIRKSDELLHNV (SEQ ID NO:108).

The peptide represents the DP178-like region of the RSV F1 protein and has substantial antiviral activity against RSV as discussed in Section 17.2 above and shown in FIG. 22A.

T112 analogs were generated according to at least three different strategies to generate peptides based on T112 that would still bind to the DP107-like domain of the RSV F1 protein but with a lower binding affinity. First, a truncated peptide was generated, reducing the length of the peptide from 35 to 28 amino acid residues. Specifically, the truncated peptide, which is referred to herein as T67, had the amino acid sequence:

DEFDASISQVNEKINQSLAFIRKSDELL (SEQ ID NO:63)

corresponding to amino acid residues 486–213 of the F1 fusion protein. The binding affinity of the peptide to the DP107-like domain of F1 protein was determined according to the methods described in Section 5.7.1 above. The truncated peptide had a binding affinity (5 nM) that was five times lower than that of the full-length T112 peptide (2 nM).

As part of a second strategy, the peptides identified as T800 through T811 in FIG. 23 were synthesized to identify particular amino acids in T112 that contribute to a larger part of that peptide's binding affinity. As a whole, these alanine substitutions represent an "alanine-scanning" type walk across the sequence of T112.

Each of the peptides synthesized had a change of three consecutive amino acid residues in the T112 sequence to three alanine residues. Each peptide was tested for its ability to inhibit the binding of the native peptide (i.e., of T112) in a competitive binding assay as described in Section 5.7.1 above. The results are also shown in FIG. 23. In particular, the peptides T802, T804, T807 and T810 had significantly reduced affinity for the DP107-like target, suggesting that the regions containing amino acid residues 488–490, 494–496, 503–505 and 512–514 of the RSV F1 protein (amino acid residues 7–9, 13–15, 22–24 and 31–33, respectively, of T112), contribute significantly to the high binding affinity of T112 for its DP107-like target in the RSV F1 protein.

The peptides T1669–T1673 and T1680 through T1684 were then synthesized, each of which contains a single alanine substitution at one of the above-listed amino acid residue positions of T112. The binding affinity of these peptides for their DP107-like target can also be determined by means of the same routine screening assays, thereby identifying individual amino acid residues which affect binding affinity of T112.

Furthermore, an additional novel peptide, referred to as T1091, was generated by modifying various amino acid residues in the T112 sequence which were identified, using standard principles of protein and design, as affecting properties such as binding affinity, solubility and biological stability. Specifically, the following amino acid residue substitutions were made: $F_2 \rightarrow Y$, $S_{21} \rightarrow A$, $F_{24} \rightarrow Y$ and $S_{28} \rightarrow A$, wherein the subscript numerals indicate the amino acid residue position in T112. The resultant peptide, which is referred to herein as T1091, thus had the amino acid sequence:

VYPSDEFDASISQVNEKINQALAYIRKADELLHNV (SEQ ID NO:933).

The binding affinity of this novel peptide for the DP107 target was found to be 19 nM, i.e., approximately ten-fold less than the binding affinity of T112.

The data demonstrates that peptides having a reduced binding affinity for a DP107 target (i.e., for an HR1 domain) maybe readily found by modifying a DP178 peptide such as T112, e.g., by means of the routine techniques and assays described herein. Further, the techniques and assays identify key amino acid residues which may be used to construct and identify other reduced affinity peptides.

13. EXAMPLE: IDENTIFICATION OF HIV DP107/DP178 ANALOGS WITH REDUCED BINDING AFFINITIES

In the example presented herein, peptides derived from DP178, which is also referred to as T20, are described and tested for binding affinity to the DP107 domain of the HIV gp41. Particular peptides are identified that have a reduced binding affinity for their DP107 target, and key amino acid residues are identified the confer high binding affinity to the native peptide (i.e., to T20). Such peptides are useful, e.g., in screening assays such as those described above in Section 5.7.1 to identify compounds which inhibit or disrupt the interaction between DP107 and DP178.

Specifically, the peptides identified as T813 and T868 through T878 in FIG. 23 were synthesized to identify particular amino acids in T20 (DP178) that contribute to a greater part of that peptide's binding affinity. Each of the peptides synthesized had a change of three consecutive amino acid residues in the T20 sequence to three alanine residues. The antiviral activity of each peptide was assayed in cell fusion assays as described in Section 6.1.3, above. The binding affinities of the peptides were also measured in a competitive binding assay described in Section 5.7.1 above, wherein each peptides ability to disrupt the binding of either biotin (T83) or fluorescein (T1342) labeled DP178 (T20) to the M41Δ178 fusion protein described in Section 8, above, was measured. The binding affinity of each peptide to the peptide referred to as T764 (GSTMGARS MTLTVQARQLLSGIVQQNNLLRAIEAQQH) (SEQ ID NO:670) was also measured using circular dichroism to monitor the amount of secondary structure (i.e., helicity) adopted by the peptides. T764 is a peptide which represents the DP107 target domain of DP178 (T20).

The results are provided in FIGS. 24A–B. In particular, the peptides T813, T878, T874–T876 and T871 have significantly reduced affinity for the DP107 region, suggesting the regions corresponding to the substituted amino acid residues in those peptides contribute significantly to the high binding affinity of T20. The peptides T1627–T1632, T1650–T1653 and T1656-T1665 were then synthesized. Each of these peptides contains a single alanine substitution at one of the amino acid residues in one of the regions identified as contributing significantly to the high binding affinity of T20. Identical assays which measured the binding affinity of these peptides identified four essential residues ($I_{646}$, $Q_{652}$, $Q_{653}$ and $N_{656}$, with the subscript numerals indicating the residue position in the HIV-$1_{LAI}$ gp41 amino acid sequence) in which alanine-substitution completely prevented binding to the DP107 domain, as well as five residues ($L_{641}$, $I_{642}$, $I_{645}$, $E_{657}$ and $L_{663}$, with the subscript numerals indicating the residue) in which alanine-substitution position in the HIV-$1_{LAI}$ gp41 amino acid sequence reduced the binding affinity, but did not actually block binding to the DP107 domain.

The data demonstrates that peptides having a reduced binding affinity for a DP107 target (i.e., for an HR1 domain) may be readily found by modifying a DP178 peptide such as T20, e.g., by means of the routine techniques and assays described herein. Further, the techniques and assays identify key amino acid residues which may be used to construct and identify other reduced affinity peptides.

14. EXAMPLE: POLYPEPTIDES CORRESPONDING TO HR2 REGIONS OF AN RSV PROTEIN

The example presented in this section discloses novel peptides that correspond to an HR1 domain of the respiratory syncytial virus (RSV) fusion protein. Specifically, this example describes experiments through which amino acid sequences of an HR1 domain of the $F_1$ subunit of an RSV fusion protein were identified. The example also discloses novel DP107-like peptides whose amino acid sequences correspond to this HR1 domain. Data are presented demonstrating that the novel peptides form coiled-coil multimer complexes in solution and, further, associate with an DP178-like peptide to form a six membered coiled-coil complex. The novel peptides are therefore useful, e.g., as antiviral agents or in the screening methods of the present invention.

14.1. Materials and Methods

Cloning and Expression of Recombinant RSV $F_1$ Constructs:

Full length RSV-F protein gene cDNA was cloned by standard recombinant techniques using a recombinant vaccinia virus containing the RSV (strain A2) F protein gene as a PCR templat (Olmsted & Elango, 1986, Proc. Natl. Acad. Sci. U.S.A. 83:7462–7466). Both the full length F protein gene and a truncated version were cloned. The full length F protein gene, referred to herein as clone F0, encoded a polypeptide of 574 amino acid residues depicted in FIG. 25. The truncated version of the F protein gene, referred to herein as clone F1ΔHR2/FP, encoded a polypeptide corresponding to amino acid residues 142–485 of the full length F protein depicted in FIG. 25.

Both the full F protein gene and the truncated version were initially cloned into the pFLAG-ATS vector (IBI-Kodak) and then subsequently recloned into the pMAL c2 vector (New England Biolabs, Boston Massachusetts) to generate hybrids with the E. Coli maltose binding protein (MBP). Thereafter, the specific PCR primers shown in Table VIII were designed such that they contained restriction sites permitting in-frame hybrids between MBP and RSV F protein truncations indicated in FIG. 25.

TABLE VIII

| Fusion | Primer Sequence | |
|---|---|---|
| MF-IV | 5'-GGAAGGAATTCCCGGTTAGG-3' | sense |
| | 5'-TGCTCTAGACTATTGTACTACATATGC-3' | antisense |
| MF-III | 5'-GGAAGGAATTCCCGGTTAGG-3' | sense |
| | 5'-TGCTCTAGACTACTTAGATACAGCAACG-'3 | antisense |
| MF-II | 5'-GGAAGGAATTCCCGGTTAGG-3' | sense |
| | 5'-TGCTCTAGACTATTGTTTATCTATATAGTTTTT-3' | antisense |
| MF-I | 5'-GGAAGGAATTCCCGGTTAGG-3' | sense |
| | 5'TGCTCTAGACTAGTCTAACACTTTGCTGG-3' | antisense |
| | (SEQ ID NOS: 1897–1901, respectively) | |

The primers were used in PCR reactions with the F1ΔHR2/FP (pJAMCF4.C12) recombinant clone as template. The PCR products were ligated into pMAL-c2 vector which was transformed into bacteria. Resulting recombinants were verified by sequence analysis. Recombinant protein was expressed in culture and biochemically purified by affinity chromatography using an amylose resin as recommended by New England Biolabs.

Proteinase-K Protection Experiments:

60 μg of the various RSV-$F_1$ constructs were incubated for one hour at room temperature with or without 4 μg T112 peptide in 80 μl final reaction volume containing 10 mM Tris (Hydroxymethyl) aminomethane (TRIS, Sigma, St. Louis, Mo.), 200 mM sodium chloride (Sigma, St. Louis, Mo.), 50 mM maltose (Fisher, Pittsburgh, Pa.), and 1 mM EDTA (Fisher, Pittsburgh, Pa.) at pH 7.4. Mixtures were treated with 5 μg/ml proteinase-K (Sigma, St. Louis, Mo.) or an equivalent volume of buffer, vortexed and then incubated for one hour at 37° C. Phenyl methyl sulfonyl fluoride (PMSF, Boehringer Mannheim, Indianapolis, Ind.) was added to achieve a 2 mM final concentration to stop proteolytic digestion. 20 μl of each sample was removed and added to 10 μl of a sample buffer (New England Biolabs, Boston, Mass.) containing 6 w/v% Sodium Dodecyl Sulfate (DDS), DTT, 187.5 mM TRIS, 30% glycerol and bromophenol blue. The mixtures were heated for five minutes at 90° C. 15 μl of the samples were run on a 10–20% Tricine polyacrylamide gel (Novex, San Diego, Calif.), stained with Coomassie brilliant blue and destained with a 10% methanol-10% acetic acid mixture (Fisher, Norcross, Ga.). All proteins were treated identically except that the MF-II samples were lyophilized after the addition of PMSF and resuspended in a smaller volume to achieve solute concentrations comparable to those of the other three fusion constructs. Treatment of the other constructs in this manner produced results identical to those reported hereinbelow.

Peptide Synthesis and Purification:

Peptide synthesis was performed on a Rainin Symphony multiplex peptide synthesizer (Rainin Instrument Company, Woburn, Mass.) using 9'fluorenylmethoxycarbonyl (FMOC) chemistry protocols (Fields & Nobel, 1990, *International Journal of Peptide & Protein Research* 35:161–214; King & Fields, 1990, *International Journal of Peptide & Protein Research* 36:255–266). Peptides were synthesized on Rink Amide MBHA resin (0.40 meq., Peptides International, Louisville, Ky.) for C-terminal amides and acetylated on the N-terminus using acetic anhydride (Mallinkrodt Baker, Inc., Phillipsburg, N.J.) and NMM in DMF (1:1:20 v/v). FMOC amino acids (10 eq., Rainin Instrument Comp., Chem Impex International, Peptides International and Genzyme Pharmaceuticals, Cambridge, Mass.) were activated in situ using 1-Hydroxybenzotriazole (HOBt, Chem Impex International), O-(Benzotriazol-1-yl)-N,N,N',N'-tetramethyluronium hexafluorophosphate (HBTU, Quantum Biotechnologies, Montreal, Qc, Canada) and N-methylmorpholine (NMM, Chem Impex International) with coupling reactions proceeding for 30 minutes. For some residues (arginine, asparagine, glutamine, histidine, tryptophan and proline) double coupling reactions were routinely performed. Removal of the FMOC group was performed using 20% Piperidine (PIP, Chem Impex International, Wood Dale, Ill.) in dimethylformamide (DMF, Allied/Burdick and Jackson, Muskegon, Mich.) with the residual PIP being removed by 3×DMF washes. Peptide cleavage from the resin support was performed using 90% trifluoroacetic acid (TFA), 5% dithiothreitol (DTT) and 5% water (10 ml per 400 mg resin) for 2 hours at room temperature, followed by precipitation in cold ethyl ether. The precipitated peptide was centrifuged to pellet (1250×g for 5 min., Jouan, Inc., Winchester, Va.) and washed three times with ehtyl ehter. Peptide pellets were dried under vacuum and re-dissolved in 50% acetonitrile (ACN, Allied/Burdick and Jackson). Peptides were analyzed and purified by Reverse Phase High Performance Liquid Chromatography (RP-HPLC) on a C-8 column (Vydac C-8, 4.6×250 mm or 5.0×25 cm, Vydac Separations Group, Hesperia, Calif.) using an ACN/water/TFA buffer system (Buffer A: 0.1% TFA in water; Buffer B: 0.1% TFA in ACN). Analytical HPLC absorbance profiles at 222 nm were obtained on a Rainin/Varian analytical system using a gradient of 30–60% Buffer B over 30 min. at 1.0 ml/min. The purification of peptides was performed on a Waters Prep 4000 or Rainin/Varian SD-1 Prep system using a gradient of 30–60% Buffer B over 60 min. at 50 ml/min or 60 mmin, respectively. Factions were collected and analyzed as previously mentioned and pooled to obtain peptides that were greater than 95% pure. The pooled effluent was lyophilized and dried peptide stored at 4° C. or −20° C. with dessicant.

Peptide content was determined by amino acid analysis performed at the University of Michigan, Protein & Carbohydrate Structure Facility (Ann Arbor, Mich.). Peptide solutions were prepared with PBS buffer containing 100 mM NaCl (Sigma, St. Louis, Mo.) and 50 mM sodium Phosphate (Sigma, St. Louis, Mo.) adjusted to pH 7. Peptide concentrations were determined by one of two methods: either based on weight and volume, corrected for peptide content; or by direct amino acid analysis of the prepared stock solutions (Biosynthesis, Inc., Lewisville, Tex.). Dilution of the stock solutions to final concentrations as noted in the text were performed in PBS.

Circular Dichroism Spectroscopy:

Circular Dichroism (CD) spectra were obtained using an AVIV Associates 62DS spectrometer equipped with a thermoelectric temperature controller. Spectra were obtained in 0.1, 0.5 and 1.0 cm quartz cells at 1° C. with 0.5 nm steps from 200 to 260 nm, 1.5 nm bandwidth and an averaging time of 4 sec/step. After the cell/buffer blank was subtracted, spectra were smoothed using a third-order least-squares polynomial fit with a conservative (5–10 point) window size to give random residuals. Mixing experiments were performed by comparing the spectrum of the two peptides mixed together in a 0.1 cm path length cell at the desired concentrations (referred to herein as the "experimental" spectrum) to the sum of the individual spectra of the peptides, each solution in a 0.1 cm path length cell (referred to herein as the "model spectrum" for no peptide interaction or "model for no interaction").

Raw ellipticity values were converted to mean residue ellipticity using standard methods (Cantor & Schimmel, 1980, *Biophysical Chemistry Part II: Techniques for the Study of Biological Structure and Function*, W.H. Freeman and Co., New York). Conversions for the mixing experiment spectra were performed using a peptide length corresponding to the average of the two peptides. Thermal stability measurements were performed in 2° C. steps, with 1 minute equilibration times. Spectra were smoothed, converted to mean residue ellipticity, and the corresponding value at 222 nm noted from each spectrum. Percent helicity values were calculated using single value decomposition with a basis set of 33 protein spectra (Johnson & Curtis, 1990, *Proteins: Structure, Function and Genetics* 7:205–214).

Analytical Ultracentrifugation:

Sedimentation equilibrium experiments were performed on a Beckman Optima XL-A analytical ultracentrifuge at 4° C. Six-channel cells (12 mm optical path length) were used with an An-60 Ti rotor operated at 13,500, 16,000, 17,000, 20,000, 21,000, 24,000, 25,000, 27,500, 30,000 and 35,000 rpm. The cell radii were scanned using 0.001 cm steps with 10 averages/scan. Data were analyzed using Beckman XLA data analysis software (version 3.01 for Windows) and Beckman-Origin software (version 3.78 for Windows). The methods described by Laue et al. (1992, in *Analytical Cultracentrifugation in Biochemistry and Polymer Science*, Harding et al., eds., pp.90–125, Royal Society of Chemistry, Cambridge) were used to calculate partial specific volumes (v-bar, ml/g: T1581=0.7539; T1582=0.7574; T1772=0.7546; T1584=0.7574; T1623=0.7557; T112=0.7230) and the solvent density (p=1.00895) at 4° C. For peptide mixtures, a concentration-weighted average v-bar was used (for T1772:T112 ratios: v-bar=0.7388 for 50:50 μM; 0.7493 for 50:10 μM; 0.7335 for 50:100 μM). The partial specific volumes were held constant for all models considered.

Single data files were normalized to 270 nm absorbance values using Beer's Law. The data obtained with solutions containing the DP107-like peptides were then analyzed using a single ideal species model to determine a weight-averaged molecular weight ($M_w$). Diagnostic plots of $M_w/M_{w0}$ vs. rpm/rpm$_0$ and $M_w$ vs. radial concentration were used to test for sample homogeneity as described, e.g., by McRorie & Voelker, 1993, *Self-Associating Systems in the Analytical Ultracentrifuge*, Beckman Instruments, Inc., Palo Alto; and Yphantis et al., 1978, in *Physical Aspects of Protein Interactions: Proceedings of the Symposium on Protein Interactions, American Chemical Society Meeting*, Catsimpoolas, Ed., pp. 275–303, Elsevier, Miami Beach, Fla. When systematic residuals or a $M_w$ higher than the monomer molecular weight indicated the presence of self-association, associative models such as monomer/trimer, monomer/tetramer and monomer/dimer/tetrarner were investigated. The suitability of a particular model (i.e., the goodness of fit) was judged by the trends observed in the residuals (Johnson & Straume, 1994, in *Modern Analytical Ultracentrifugation*, Schuster et al., eds., pp. 37–65, Birkhauser, Boston). Using the associative model which produced random residuals when fitting individual data files, a simultaneous, global, weighted fit of multiple data files (up to nine files with different concentrations and speeds) was performed to determine the association constant and 95% confidence intervals. To convert the resulting association constant from absorbance units to concentration units, it was assumed that the absorbance of the n-mer is n times that of the monomer.

The data obtained with DP107-like/DP178-like peptide mixtures were first analyzed with a single ideal species model. When a systematic trend in residuals coupled with the $M_w$ not equal to a precise multimer of HR1+HR2 were obtained, and alternate fitting scheme was explored. For this approach, it was assumed that the solution contained fully associated HR1–HR2 complexes and unassociated DP107-like and DP178-like peptides. The mixtures were analyzed with a two-ideal species model, choosing one species to have a molecular weight of either 28,269 Da (corresponding to three DP107-like plus three DP178-like peptides) or 37,269 Da (corresponding to four DP107-like plus four DP178-like peptides). The other ideal species was taken to be 8,400 Da, i.e., the average molecular weight of the DP107-like peptide T1772 (12,797 Da) and the DP178-like peptide T112 (4,030 Da).

14.2. Results

RSV F1 Fusion Proteins:

Several chimeric proteins were prepared in which different portions of the RSV $F_1$ protein subunit were linked to the *E. coli* maltose binding protein (MBP). A schematic overview of the RSV F protein and the domains used in these fusion proteins is shown in FIG. 26. Amino acid residue numbers are provided with respect to the full length RSV-F protein sequence shown in FIG. 25.

Four fusion proteins, referred to as MF-I through MF-IV, respectively, which consist of the amino acid residues from the $F_1$ domain of RSV F protein indicated in Table IX, below, fused to the carboxy terminus of MBP were constructed. The latter three fusion proteins included amino acid sequences corresponding to either a portion of (MF-II and MF-III) or the complete (MF-IV) HR1 domain of the RSV F fusion protein. Additional fusion proteins, referred to as MF9.1, MF8.1, MF13, MF12, MF7.1, MF11, MF10, MF6.1, MF5.1 and MF4.1, respectively, were created as indicated in FIG. 25. In particular each of these fusions consisted of RSV $F_1$ sequences beginning at amino acid residues 142 and ending at the amino acid residue indicated by the arrows in FIG. 25. It is noted that the fusion proteins designated MF9.1, MF13, MF12 and MF5.1 were, in fact, identical to the fusion proteins MF-I through MF-IV, respectively, described above.

TABLE IX

| Fusion | RSV F Protein Residues |
|---|---|
| MF-I (MF9.1) | 142–156 |
| MF-II (MF13) | 142–194 |
| MF-III (MF12) | 142–202 |
| MF-IV (MF5.1) | 142–302 |
| MF8.1 | 142–186 |
| MF7.1 | 142–208 |
| MF11 | 142–224 |
| MF10 | 142–240 |
| MF6.1 | 142–263 |
| MF4.1 | 142–485 |

Proteinase-K Protection Experiments:

To more precisely identify the HR1 domain of RSV-F1 to which the HR2 region and/or peptides derived therefrom bind, limited proteolysis experiments were performed using the DP178-like peptide referred to herein as T112. T112 is a peptide 35 amino acid residues in length and having an amino acid sequence corresponding to amino acid residues 482–516 of the full length RSV F protein sequence shown in FIG. 25; i.e., the amino acid sequence:

T112: VFPSDEFDASISQVNEKINQSLAFIRKS-DELLHNV (SEQ ID NO:##)

As demonstrated hereinbelow, the T112 peptide binds to the HR1 domain of RSV-F1 and thereby protects the domain from proteolytic digestion. It is noted that similar protection is not observed when two other 35 amino acid peptides derived from the RSV-F1 HR2 region are used in an identical proteolytic assay. Specifically, these two alternate peptides were shifted by five residues towards the amino terminus (i.e., corresponding to amino acid residues 477–511) and seven residues towards the carboxy terminus (i.e., corresponding to amino acid residues 489–523), respectively, of the RSV F protein.

FIG. 27A presents SDS-PAGE results from a first experiment in which binding of T112 to the MF-IV protein is shown to protect both the peptide and a portion of the MF-IV protein from proteolytic digestion. Non-digested MF-IV is shown in lane 2 with the major component at approximately 60,000 Da apparent molecular weight (theoretical molecular weight=60,524 Da). Treatment of MF-IV alone with proteinase-K (FIG. 27A, lane 3) yields two doublet bands at approximately 40 and 20 kDa. These bands appear to be derived from the MBP portion of the fusion protein since the same pattern is observed upon protease digestion of MBP alone. Non-digested T112 peptide alone is shown in lane 4. Treatment of the peptide with proteinase-K digest the peptide entirely (FIG. 27A, lane 5). Lane 6 presents the mixture of MF-IV with T112. Comparison of the proteinase-K treated mixture of MF-IV and T112 (FIG. 27A, lane 7) with the proteinase-K treated protein MF-IV (FIG. 27A, lane 3) and T112 (FIG. 27A, lane 5) reveals two short fragments which are only apparent following digestion of the mixture of T112 and MF-IV. One band is coincident with the native T112 (sequence molar mass 4,030 Da). A second band of approximately 4,500 Da appears as well. N-terminal sequencing of this second fragment reveals the sequence "VLHLE" (SEQ ID NO:##) which is found in the amino terminal region of the F1-protein (amino acid residues 157–161 of the full length F protein) and is within the region identified as HR1.

FIG. 27B presents data from the next series of experiments which identify the approximate C-terminus of HR1 required for binding of the DP178-like peptide T112. Proteinase-K protection experiments identical to those described above were done using the shorter protein constructs MF-I through MF-III, respectively, described above and corresponding to different lengths of the $F_1$-protein. The constructs MF-I and MF-II show no protection from proteinase-K digestion as a result of mixing with T112 (FIG. 27B; lane 3 vs. lane 4, and lane 6 vs. lane 7, respectively). However, the construct MF-III shows protection from proteinase-K digestion in the presence of T112 (FIG. 27B; lane 9 vs. lane 10) similar to that observed with the longer MF-IV protein. Further, the MF-III protected fragment is visibly shorter (4,150 Da apparent molecular weight) than the fragment produced by the longer MF-IV construct (4,500 Da apparent molecular weight). Thus, these data, taken together, indicate that the minimal C-terminal end of the HR1 target region required for DP178-like peptide binding is within the sequence "LKNYIDKQ" (SEQ ID NO:##).

As a control for non-specific binding, comparison of lanes 12 and 13 in FIG. 27B demonstrates that the T112 peptide does not bind to an MBP fusion protein containing the ectodomain of the HIV-1 fusion protein gp41 as no protected fragment is observed in the presence of T112.

Synthetic DP107-like Peptides:

Several peptides corresponding to the HR1 domain of RSV $F_1$-protein were synthetically prepared to further examine and characterize the HR1/HR2 interactions of the RSV $F_1$-protein. The amino acid sequence of each of these peptides, referred to as T1536, T1590, T1585, T1582, T1581, T1583, T1772, T1584 and T1623 (SEQ ID NOS:###, respectively) are shown in FIG. 28. Each of these peptides represents different lengths of the HR1 region identified by the SDS-PAGE experiments described above. In particular, the peptide T1581 has the exact N-terminal sequence (i.e., "VLHLE") that was identified from the above described proteinase-K experiments on MF-IV and the C-terminal sequence (i.e., "LKNYIDKQ") suggested by the proteinase-K experiments on MF-II and MF-III. The peptides T1582, T1585, T1590 and T1536 are shorter than T1581 while the remaining peptides (i.e., T1772, T1593, T1584, T1623) are longer than T1581.

CD Studies of RSVDP107-like Peptides:

The solution-phase structures of the RSV DP107-like peptides shown in FIG. 28 were further examined by means of Circular Dichroism (CD) Spectroscopy. FIG. 29A presents the normalized CD spectra (mean residue elipticity) of the RSV DP107-like peptides T1590 (closed circles), T1582 (open circles), T1581 (closed triangles), T1772 (open triangles), T1584 (closed squares) and T1623 (open squares) at 35 μM concentration. As the length of the peptide increases, more helical character is adopted by the peptide in solution, as demonstrated by the two minima at 208 and 222 nm, respectively (Cantor & Schimmel, 1980*, Biophysical Chemistry Part II. Techniques for the Study of Biological Structure and Function*, W.H. Freeman and Co., New York).

The amount of helical secondary structure is maximal for the peptides T1772, T1584 and T1623. In particular, the amount of helical secondary structure was calculated for each peptide as described, above, in Section 14.1. The percentage of helical secondary structure calculated for each peptide is provided, below, in Table X. The means residue ellipticity at 222 nm was also measured for each peptide as a function of temperature to investigate the thermal stability of these secondary structures. These data are plotted in FIG. 29B. The midpoints of "melting transitions" ($T_m$) for these peptides, which are also provided in Table X, below, also increase with length indicating that thermal stability of the helical secondary structure increases as the peptide length increases. This increase reaches a maximum for the peptide T1584 as no significant increase in stability is observed for the peptide T1623. The results therefore identify the DP107-like peptide T1772 contains the minimal sequence required for maximum helicity of the HR1 region (85–90%), while the peptides T1584 and T1623 demonstrate maximum thermal stability.

TABLE X

| Peptide | %-Helicity | $T_m$ |
|---|---|---|
| T1590 | 10% | <10° C. |
| T1582 | 49% | 22° C. |
| T1581 | 69% | 31° C. |
| T1772 | 83% | 42° C. |
| T1584 | 90% | 53° C. |
| T1623 | 88% | 55° C. |

The thermal stability of the peptide T1772 was examined more thoroughly by measuring the mean residue ellipticity for different concentrations of this peptide. The amount of helicity, as calculated from the full CD spectra, for different concnetrations of T1772 peptide, are provided in Table XI, below. These data show that as the concentration of T1772 peptide is increased the amount of helicity increases from 67% (1 μM peptide concentration) up to 90% (100 μM peptide concentration). Thermal melting curves for T1772 were also obtained by measuring the residue ellipticity at 222 nm of different concentrations of T1772 peptide as a function of temperature. These data are plotted in FIG. 30 and show that as T1772 peptide concentration increases the midpoint of the thermal melting curve (Tm) also increases, from 30° C. (1 μM peptide concentration) to 46° C. (100 μM peptide concentration), demonstrating increased thermal stability. Similar concentration-dependent results were obtained for the other RSV DP107-like peptides described above. Such concentration-dependence of the helicity and thermal stability for these peptides demonstrates that such RSV DP107-like peptides self-associate in solution in a helical secondary structure.

TABLE XI

| T1772 Conc. | %-Helicity | $T_m$ |
|---|---|---|
| 1 μM | 67% | 30° C. |
| 10 μM | 80% | 32° C. |
| 35 μM | 83% | — |
| 50 μM | 84% | 42° C. |
| 100 μM | 90% | 46° C. |

Sedimentation Equilibrium Experiments of RSVDP107-like Peptides:

Oligomerization states of the RSV DP107-like peptides shown in FIG. 28 were measured by the analytical ultra centrifugation methods described in Section 14.1, above. Specifically, sedimentation equilibrium experiments were performed on 35 μM peptide samples at rotor speeds of 25K, 30K and 35K rpm and the data from these experiments were fit using a single ideal species model to determine a weight-averaged molecular weight ($M_w$) for each sample. The constant $M_w$ values obtained at different rotor speeds confirmed the homogeneity of each sample.

The resulting $M_w$ values are listed, below, in Table XII. Specifically, these $M_w$ values are averages of results obtained from three independent samples preparations tested at the three different rotor speeds. Each of the RSV DP107-like peptides gives $M_w$ values that are higher than those of the monomer peptide molecular weights calculated from their sequences. The ratios of the measured $M_w$ values to the calculated monomer molecular weights range from 1.5 for the shortest peptide investigated in these experiments (T1582) to 2.2 for the longest peptide (T1623) (see column 5 of Table XII, below). The data demonstrate, therefore, that a self-association of the peptides occurs and, further, that the extent of this self association is dependent on peptide length.

TABLE XII

| Peptide | Monomer Molecular Weight | Weight-Averaged Molecular Weight (g/mole) | Range of Chi-squared values[b] | N-mer[c] |
|---|---|---|---|---|
| T1582 | 4897 | 7,521 ± 271 (4%) | 1.2860e-5, 6.6022e-5 | 1.5 |
| T1581 | 5007 | 9,125 ± 466 (5%) | 4.9958e-6, 1.1037e-4 | 1.8 |
| T1772 | 5393 | 12,897 ± 398 (3%)[a] | 1.8697e-7, 2.7917e-5 | 2.4 |
| T1584 | 5506 | 11,703 ± 653 (6%) | 9.7047e-6, 2.8735e-4 | 2.1 |
| T1623 | 5750 | 12,899 ± 1225 (10%) | 4.0381e-5, 2.8391e-4 | 2.2 |

[a]Value reported is at 25 $\mu$M determination.
[b]Smallest and larges Chi-squared values from the set of single ideal species fits used to produce the reported $M_w$.
[c]Value is equal to the weight-averaged molecular weight (column 3) divided by the monomer molecular weight (column 2).

Additional sedimentation equilibrium experiments were performed on the RSV DP107-like peptide T1772, the shortest peptide demonstrating maximum helicity in the CD experiments. In particular, two independent T1772 sample preparations at a range of concentrations (15, 25, 50, 75, 100 and 150 $\mu$M) were tested at a range of rotor speeds (13,500 rpm, 16,000 rpm, 17,000 rpm, 21,000 rpm, 24,000 rpm, 27,500 rpm and 30,000 rpm) and the individual data files were fit using a single ideal species model to determine a weight-averaged molecular weight for each concentration. The constant $M_w$ values obtained at the three different rotor speed and overlapping traces on a graph of $M_w$ vs. the radial concentration for the six concentration verified the homogeneity of each sample. The results are shown in Table XIII, below. In particular, the $M_w$ values obtained show only a very slight concentration dependence in which the $M_w$ value at 15 $\mu$M concentration is only 7% lower than the average calculated from the $M_w$ values determined for the five highest peptide concentrations. The average $M_w$ is 2.4 times the monomer molecular weight, indicating self-association of the T1772 peptide in solution.

TABLE XIII

| Concentration (mM) | Weight-Averaged Molecular Weight | Range of Chi-squared values[a] |
|---|---|---|
| 15 | 11,915 ± 699 (6%) | 9.2561e-8, 2.9123e-5 |
| 25 | 12,897 ± 398 (3%) | 1.8697e-7, 2.7917e-5 |
| 50 | 12,797 ± 594 (5%) | 1.4797e-7, 2.6800e-5 |
| 75 | 12,588 ± 369 (3%) | 7.2019e-4, 4.9504e-5 |
| 100 | 13,036 ± 637 (5%) | 3.1340e-6, 9.2988e-6 |
| 150 | 12,523 ± 465 (4%) | 8.3774e-6, 1.6254e-5 |

[a]Smallest and largest Chi-squared values from the set of single ideal species fits used to produce the reported $M_w$.

The homogeneous self-association of the T1772 peptide was further characterized by selecting different association models and testing each model for its ability to reproduce the data from the above described ultra centrifugation experiments. The results of this analysis using unltra centrifugation data from a 100 $\mu$M T1772 sample at 24,000 rpm rotor speed is shown in FIGS. 31A–D. In particular, these figures plot the sedimentation equilibrium data from this sample (open circles) superimposed on predicted results (solid lines) from different mathematical models for peptide association. Residuals from fits of these models to the experimental data are displayed above each plot.

The single ideal species model (FIG. 31A) predicts a $M_w$ of 12,925 Da and produces a fit with some systematic trend in the residuals, indicating that, in fact, there is more than one molecular species present in solution. The data were also fit to a monomer/tetramer association model (FIG. 31B), and monomer/trimer association model (FIG. 31C). An addition data fit was performed using a more elaborate monomer/dimer/tetramer model. Of these different models, only the monomer/trimer model produces random residuals over all the data sets (i.e., for all concentrations and rotor speeds). Thus, a trimeric self-association model best reproduces the data set. Accordingly, this model was examined in more detail.

In particular, a global fit of multiple data sets was performed using a monomer/trimer equilibrium model. The data sets were divided into two groups of nine data sets each: Group I consisted of data from experiments performed with 15, 50 and 100 $\mu$M sample concentrations at rotor speeds of 16,000 rpm, 24,000 rpm and 27,500 rpm; Group II consisted of data from experiments performed with 25, 75 and 150 $\mu$M sample concentrations at rotor speeds of 16,000 rpm, 24,000 and 27,500 rpm.

The global fits were performed by first holding the baseline offset for each data set constant at zero while allowing the association constant to vary. After this minimum was found, the association constant and each data set's baseline offset were allowed to vary. FIG. 31D plots the data from ultra centrifugation experiments performed on a 100 $\mu$M sample of T1772 at a rotor speed of 24,000 rpm (closed circles) superimposed on the resulting fit (solid line). The fits produced random residuals for this and the other data sets confirming that the monomer/trimer equilibrium model is the appropriate model. The values of the association constants ($K_a$) and the goodness of fit for each Group are listed, below, in Table XIV, along with the average values. Both Groups of data produced virtually identical results for the association constants with 95% confidence limits (CL).

TABLE XIV

| | $K_a$ | CL | Goodness of Fit |
|---|---|---|---|
| Group I: | $5.03 \times 10^8$ M$^{-2}$ | $(4.16–6.10) \times 10^8$ M$^{-2}$ | 0.07824 |
| Group II: | $5.37 \times 10^8$ M$^{-2}$ | $(4.49–6.71) \times 10^8$ M | 0.1342 |
| Average Value: | $52 \times 10^8$ M$^{-2}$ | $(4.2–6.4) \times 10^8$ M | |

Structural Characterization of RSV DP178-like Peptide:

CD and ultra centrifugation experiments identical to those described above for RSV DP107-like peptides were also performed using samples of the RSV DP178-like peptide T112 (SEQ ID NO:##). In contrast to T1772 and the other RSV DP178-like peptides, T112 demonstrates little secondary structure, as shown by its CD spectra at sample concentrations of 10 and 50 $\mu$M (FIG. 32A). Calculations based on these spectra predict less than 10% helicity in PBS solution. Likewise, CD melting curves of the 10 and 50 $\mu$M solutions of T112 (FIG. 32B) show that there is little thermal stability at either concentration.

Sedimentation equilibrium studies of 50 $\mu$M samples of T112 at rotor speeds of 25,000 rpm, 30,000 rpm and 35,000 rpm resulted in a $M_w$ value of 3,984 Da. Comparison of this $M_w$ value to the monomer molecular weight predicted from the peptide's amino acid sequence (4,030 Da) confirms that T112 behaves as a monomer in solution.

Structural Characterization of RSV DP107-like/DP178-like Peptide Mixtures:

CD and sedimentation equilibrium experiments were also performed on mixtures of the RSV DP178-like peptide T112 and the DP107-like peptide T1772 to investigate the interaction of these two peptides. In particular, CD spectra of mixtures of these two peptides were compared to a model for no structural change upon interaction as described, above, in Section 14.1. FIGS. 33A–B show the CD spectrum (FIG. 33A) and thermal stability analysis (FIG. 33A) for an equilmolar mixture (50 μM T1772: 50 μM T112) of the two peptides. The actual CD spectrum and melting curve (open circles) are markedly different than the results predicted by the model for no structural interaction (closed circles). The helicity value of the actual mixture was calculated from the full CD spectrum to be 86%, whereas the value predicted by the model for no structural interaction is only 55%. Thus, the data show that the peptides T112 and T1772 interact in solution resulting in a markedly increased helix content.

Likewise, the thermal stability (FIG. 33B) of actual peptide mixture (open circles) is much greater than that of the T1772 peptide alone (i.e., the stability predicted by the no interaction model; closed circles). Indeed, the melting temperature ($T_m$) of the peptide mixture is 87° C., whereas that of T1772 alone is only 42° C. Thus, the interaction of the two peptides also produces an extremely stable helical moiety.

Sedimentation equilibrium experiments were also performed on two independent sample preparations of the T1772 and T112 peptides at three different molar ratios: 50 μM T1772 and 10 μM T112; 50 μM T1772 and 50 μM T112; and 50 μM T1772 and 100 μM T112. Each of the samples was run at seven different rotor speeds: 13,500 rpm, 16,000 rpm, 17,000 rpm, 21,000 rpm, 24,000 rpm, 27,500 rpm and 30,000 rpm.

The data from these sedimentation equilibrium experiments were fit to a single ideal species model to obtain the weight-averaged molecular weight values ($M_w$) given in Table XV, below, for each sample. Diagnostic graphs of the $M_w/M_{w0}$ vs. rpm/rpm$_0$ values for the 50 μM: 50 μM mixtures of T1772 and T112 confirmed that the peptide association in these samples was homogenous. The $M_w$ values listed in Table XV reach a maximum for the sample containing an equal molar concentration (50 μM) of each peptide, demonstrating a 1:1 stoichiometry for the association of T1772 and T112.

TABLE XV

| T-1772 Concentration | T-112 Concentration | Weight-Averaged Molecular Weight | Range of Chi-squared values |
| --- | --- | --- | --- |
| 50 μM | 10 μM | 15,269 ± 649 (4%) | 1.4774e-6, 1.4195e-4 |
| 50 μM | 50 μM | 22,021 ± 1050 (5%) | 6.7290e-6, 1.2966e-4 |
| 50 μM | 100 μM | 17,282 ± 1396 (8%) | 1.5072e-5, 8.1949e-4 |

FIG. 34A shows a fit of the experimental data for the 50 μM : 50 μM peptide sample centrifuged with a rotor speed of 27,500 rpm (open circles) to the single ideal species model (solid line). Two factors indicate that this is not the appropriate model for the T1772-T112 peptide interaction in this sample. Specifically, a systematic pattern can be seen in a plot of the residuals of this fit to the experimental data (FIG. 34A above the plot). Second, the average $M_w$ determined for this sample is 22,021 Da. This $M_w$ value approaches but does not precisely correspond to an even multiple of the monomer molecular weights of T1772 and T112. In particular, the $M_w$ value is 20% lower that the Mw for a multimer species consisting of three monomers of each peptide (28,269 Da). An alternative modeling approach, similar to the approach taken by Luckow et al. (1989, Biochemistry 28:2348–2354) was therefore used. This alternative approach takes into account the fact that small amounts of individual T112 and/or T1772 peptides may be present in solution. Specifically, the alternative modeling approach simply added a second ideal species to the original model.

Two models for the final oligomerization state of the two peptides were investigated using this alternative approach: a six-membered complex (i.e., consisting of three molecules of T112 and three molecules of T1772) and an eight-membered complex (i.e., consisting of four molecules of T112 and four molecules of T1772). In both models, the second species was taken to have a molecular weight of 4,800 Da; i.e., the average of the weight averaged molecules weights for the individual peptides measured at these concentrations. The results are shown in FIGS. 34B and 34C, respectively. Specifically, FIG. 34B shows the fit obtained taking the primary species to have a molecular weight corresponding to a six-membered complex formed by three T1772 and three T112 peptides (28,269 Da). FIG. 34C shows the fit obtained taking the primary species to have a molecular weight corresponding to an eight membered complex formed by four T1772 and four T112 peptides (37,692 Da). Systematic variation can be seen in the residuals plotted in FIG. 34C from the fit to the eight-membered complex model, indicating that this is not an appropriate model for the DP107-like/DP178-like peptide complex formed in solution by T1772 and T112. However, random residuals are produced from the fit to the six-membered complex model (FIG. 34B). Similar residuals were obtained from fits of this model to data acquired at the other rotor speeds. Thus, the results demonstrate that RSV DP107-like and DP178-like peptides (e.g., T1772 and T112, respectively) associate with a 1:1 stoichiometry in solution to form a six-membered complex consisting of three DP107-like peptides (e.g., T1772) and three DP178-like peptides (e.g., T112).

In conclusion the data presented hereinabove demonstrate that RSV DP107-like peptides, including the novel DP107-like peptides shown in FIG. 38, associate with and form stable complexes with HR2 and/or peptides derived from the RSV HR2 region such as the T112 peptide described above. Thus, these peptides exhibit properties typical of fusion inhibitor (i.e., DP107-like and DP178-like) peptides and are can therefore be used in any of the applications described herein for such DP107-like and DP178-like peptides.

For example, the association properties of these peptides make them well suited for screening assays, such as the assays described in Section 5.7.1, below, to identify compounds that potentiate HR1–HR2 interactions and are useful, e.g., in mediating membrane fusion associated events, including the treatment or inhibition of viral infections such RSV infection.

RSV Plague Reduction Assay:

Cell culture assays were also performed using RSV DP107-like peptides shown in FIG. 38 according to the routine methods described, e.g., in Section 11, above. The $IC_{50}$ values determined for each of the peptides are shown in column 3 of FIG. 38. The values confirm that the peptides are also effective inhibitors of RSV infection. In particular, the peptides T1584, T1623, T1583 and T1581 are especially potent inhibitors of RSV, as demonstrated by their low IC$_{50}$ values (0.23, 0.80, 1.09 and 3.36 μg/ml, respectively). These data further demonstrate, therefore, that such peptides can also be used in the methods and compositions of the present invention for inhibiting and treating viral infections, including RSV infection.

15. REFERENCES CITED

All references cited herein are incorporated herein by reference in their entirety and for all purposes to the same extent as if each individual publication or patent or patent application was specifically and individually indicated to be incorporated by reference in its entirety for all purposes.

Many modification and variations of this invention can be made without departing from its spirit and scope, as will be apparent to those skilled in the art. The specific embodiments described herein are offered by way of example only, and the invention is to be limited only by the terms of the appended claims along with the full scope of equivalents to which such claims are entitled.

SEQUENCE LISTING (1994 sequences)

SEQ ID NO: 1 - protein, 19 aa, Artificial Sequence
  Core polypeptide
GIKQLQARILAVERYLKDQ

SEQ ID NO: 2 - protein, 19 aa, Artificial Sequence
  Core polypeptide
NNLLRAIEAQQHLLQLTVW

SEQ ID NO: 3 - protein, 18 aa, Artificial Sequence
  Core polypeptide
NEQELLELDKWASLWNWF

SEQ ID NO: 4 - protein, 18 aa, Artificial Sequence
  Core polypeptide
YTSLIHSLIEESQNQQEK

SEQ ID NO: 5 - protein, 28 aa, Artificial Sequence
  Core polypeptide
VWGIKQLQARILAVERYLKDQQLLGIWG

SEQ ID NO: 6 - protein, 28 aa, Artificial Sequence
  Core polypeptide
QHLLQLTVWGIKQLQARILAVERYLKDQ

SEQ ID NO: 7 - protein, 28 aa, Artificial Sequence
  Core polypeptide
LRAIEAQQHLLQLTVWGIKQLQARILAV

SEQ ID NO: 8 - protein, 28 aa, Artificial Sequence
  Core polypeptide
VQQQNNLLARIEAQQHLLQLTVWGIKQL

SEQ ID NO: 9 - protein, 28 aa, Artificial Sequence
  Core polypeptide
RQLLSGIVQQQNNLLRAIEAQQHLLQLT

SEQ ID NO: 10 - protein, 28 aa, Artificial Sequence
  Core polypeptide
MTLTVQARQLLSGIVQQQNNLLRAIEAQ

SEQ ID NO: 11 - protein, 27 aa, Artificial Sequence
  Core polypeptide
VVSLSNGVSVLTSKVLDLKNYIDKQLL

SEQ ID NO: 12 - protein, 28 aa, Artificial Sequence
  Core polypeptide
LLSTNKAVVSLSNGVSVLTSKVLDLKNY

SEQ ID NO: 13 - protein, 28 aa, Artificial Sequence
  Core polypeptide
VLHLEGEVNKIKSALLSTNKAVVSLSNG

SEQ ID NO: 14 - protein, 28 aa, Artificial Sequence
  Core polypeptide
LLSTNKAVVSLSNGVSVLTSKVLDLKNY

SEQ ID NO: 15 - protein, 36 aa, Artificial Sequence
  Core polypeptide
YTSLIHSLIEESQNQQEKNEQELLELDKWASLWNWF

SEQ ID NO: 16 - protein, 38 aa, Artificial Sequence
  Core polypeptide
NNLLRAIEAQQHLLQLTVWGIKQLQARILAVERYLKDQ

SEQ ID NO: 17 - protein, 42 aa, Artificial Sequence
  Core polypeptide
IELSNIKENKCNGTDAKVKLIKQELDKYKNAVTELQLLMQST

SEQ ID NO: 18 - protein, 28 aa, Artificial Sequence
  Core polypeptide
IELSNIKENKCNGTDAKVKLIKQELDKY

SEQ ID NO: 19 - protein, 28 aa, Artificial Sequence
  Core polypeptide
ENKCNGTDAKVKLIKQELDKYKNAVTEL

SEQ ID NO: 20 - protein, 28 aa, Artificial Sequence
  Core polypeptide
DAKVKLIKQELDKYKNAVTELQLLMQST

SEQ ID NO: 21 - protein, 28 aa, Artificial Sequence
  Core polypeptide
CNGTDAKVKLIKQELDKYKNAVTELQLL

SEQ ID NO: 22 - protein, 35 aa, Artificial Sequence
  Core polypeptide
SNIKENKCNGTDAKVKLIKQELDKYKNAVTELQLL

SEQ ID NO: 23 - protein, 37 aa, Artificial Sequence
  Core polypeptide
ASGVAVSKVLHLEGEVNKIKSALLSTNKAVVSLSNGV

SEQ ID NO: 24 - protein, 35 aa, Artificial Sequence
  Core polypeptide
SGVAVSKVLHLEGEVNKIKSALLSTNKAVVSLSNG

SEQ ID NO: 25 - protein, 35 aa, Artificial Sequence
  Core polypeptide
VLHLEGEVNKIKSALLSTHKAVVSLSNGVSVLTSK

SEQ ID NO: 26 - protein, 36 aa, Artificial Sequence
  Core polypeptide
ARKLQRMKQLEDKVEELLSKNYHYLENEVARLKKLV

SEQ ID NO: 27 - protein, 34 aa, Artificial Sequence
  Core polypeptide
RMKQLEDKVEELLSKNYHYLENEVARLKKLVGER

SEQ ID NO: 28 - protein, 28 aa, Artificial Sequence
  Core polypeptide
VQQQNNLLRAIEAQQHLLQLTVWGIKQL

SEQ ID NO: 29 - protein, 28 aa, Artificial Sequence
  Core polypeptide
LRAIEAQQHLLQLTVWGIKQLQARILAV

SEQ ID NO: 30 - protein, 28 aa, Artificial Sequence
  Core polypeptide
QHLLQLTVWGIKQLQARILAVERYLKDQ

SEQ ID NO: 31 - protein, 28 aa, Artificial Sequence
  Core polypeptide
RQLLSGIVQQQNNLLRAIEAQQHLLQLT

SEQ ID NO: 32 - protein, 28 aa, Artificial Sequence
  Core polypeptide
MTLTVQARQLLSGIVQQQNNLLRAIEAQ

SEQ ID NO: 33 - protein, 28 aa, Artificial Sequence
  Core polypeptide
AKQARSDIEKLKEAIRDTNKAVQSVQSS

SEQ ID NO: 34 - protein, 35 aa, Artificial Sequence
  Core polypeptide
AAVALVEAKQARSDIEKLKEAIRDTNKAVQSVQSS

SEQ ID NO: 35 - protein, 35 aa, Artificial Sequence
  Core polypeptide
AKQARSDIEKLKEAIRDTNKAVQSVQSSIGNLIVA

SEQ ID NO: 36 - protein, 28 aa, Artificial Sequence
  Core polypeptide
GTIALGVATSAQITAAVALVEAKQARSD

SEQ ID NO: 37 - protein, 28 aa, Artificial Sequence
  Core polypeptide
ATSAQITAAVALVEAKQARSDIEKLKEA

SEQ ID NO: 38 - protein, 28 aa, Artificial Sequence
  Core polypeptide
AAVALVEAKQARSDIEKLKEAIRDTNKA

SEQ ID NO: 39 - protein, 35 aa, Artificial Sequence
  Core polypeptide
IDISIELNKAKSDLEESKEWIEKSNQELDSIGNWE

SEQ ID NO: 40 - protein, 28 aa, Artificial Sequence
  Core polypeptide
IEKLKEAIRDTNKAVQSVQSSIGNLIVA

SEQ ID NO: 41 - protein, 28 aa, Artificial Sequence
  Core polypeptide
IRDTNKAVQSVQSSIGNLIVAIKSVQDY

SEQ ID NO: 42 - protein, 28 aa, Artificial Sequence
  Core polypeptide
AVQSVQSSIGNLIVAIKSVQDYVNKEIV

SEQ ID NO: 43 - protein, 50 aa, Artificial Sequence
  Core polypeptide
QARQLLSGIVQQQNNLLRAIEAQQHLLQLTVWGIKQLARILAVERYLKDQ

SEQ ID NO: 44 - protein, 28 aa, Artificial Sequence
  Core polypeptide
QARQLLSGIVQQQNNLLRAIEAQQHLLQ

SEQ ID NO: 45 - protein, 48 aa, Artificial Sequence
  Core polypeptide
MTWMEMDREINNYTSLIGSLIEESQNQQEKNEQELLELDKWASLWNWF

SEQ ID NO: 46 - protein, 35 aa, Artificial Sequence
  Core polypeptide
WMEWDREINNYTSLIGSLIEESQNQQEKNEQELLE

SEQ ID NO: 47 - protein, 28 aa, Artificial Sequence
  Core polypeptide
INNYTSLIGSLIEESQNQQEKNEQELLE

SEQ ID NO: 48 - protein, 35 aa, Artificial Sequence
  Core polypeptide
INNYTSLIGSLIEESQNQQEKNEQELLELDKWASL

SEQ ID NO: 49 - protein, 33 aa, Artificial Sequence
  Core polypeptide
EWDREINNYTSLIGSLIEESQNQQEKNEQEGGC

SEQ ID NO: 50 - protein, 28 aa, Artificial Sequence
  Core polypeptide
QSRTLLAGIVQQQQQLLDVVKRQQELLR

SEQ ID NO: 51 - protein, 44 aa, Artificial Sequence
  Core polypeptide
NNDTWQEWERKVDFLEENITALLEEAQIQQEKNMYELQKLNSWD

SEQ ID NO: 52 - protein, 28 aa, Artificial Sequence
  Core polypeptide
WQEWERKVDFLEENITALLEEAQIQQEK

SEQ ID NO: 53 - protein, 28 aa, Artificial Sequence
  Core polypeptide
VDFLEENITALLEEAQIQQEKNMYELQK

SEQ ID NO: 54 - protein, 28 aa, Artificial Sequence
  Core polypeptide
ITALLEEAQIQQEKNMYELQKLNSWDVF

SEQ ID NO: 55 - protein, 36 aa, Artificial Sequence
  Core polypeptide
SSESFTLLEQWNNWKLQLAEQWLEQINEKHYLEDIS

SEQ ID NO: 56 - protein, 10 aa, Artificial Sequence
  Core polypeptide
DKWASLWNWF

SEQ ID NO: 57 - protein, 18 aa, Artificial Sequence
  Core polypeptide
NEQELLELDKWASLWNWF

SEQ ID NO: 58 - protein, 20 aa, Artificial Sequence
  Core polypeptide
EKNEQELLELDKWASLWNWF

SEQ ID NO: 59 - protein, 23 aa, Artificial Sequence
  Core polypeptide
NQQEKNEQELLELDKWASLWNWF

SEQ ID NO: 60 - protein, 26 aa, Artificial Sequence
  Core polypeptide
ESQNQQEKNEQELLELDKWASLWNWF

SEQ ID NO: 61 - protein, 33 aa, Artificial Sequence
  Core polypeptide
LIHSLIEESQNQQEKNEQELLELDKWASLWNWF

SEQ ID NO: 62 - protein, 28 aa, Artificial Sequence
  Core polypeptide
NDQKKLMSNNVQIVRQQSYSIMSIIKEE

SEQ ID NO: 63 - protein, 28 aa, Artificial Sequence
  Core polypeptide
DEFDASISQVNEKINQSLAFIRKSDELL

SEQ ID NO: 64 - protein, 27 aa, Artificial Sequence
  Core polypeptide
VSKGYSALRTGWYTSVITIELSNIKEN

SEQ ID NO: 65 - protein, 27 aa, Artificial Sequence
  Core polypeptide
VVSLSNGVSVLTSKVLDLKNYIDKQLL

SEQ ID NO: 66 - protein, 28 aa, Artificial Sequence
  Core polypeptide
VNKIKSALLSTNKAVVSLSNGVSVLTSK

SEQ ID NO: 67 - protein, 35 aa, Artificial Sequence
  Core polypeptide
PIINFYDPLVFPSDEFDASISQVNEKINQSLAFIR

SEQ ID NO: 68 - protein, 28 aa, Artificial Sequence
  Core polypeptide
NLVYAQLQFTYDTLRGYINRALAQIAEA

SEQ ID NO: 69 - protein, 31 aa, Artificial Sequence
  Core polypeptide
LNQVDLTETLERYQQRLNTYALVSKDASYRS

SEQ ID NO: 70 - protein, 27 aa, Artificial Sequence
  Core polypeptide
ELLVLKKAQLNRHSYLKDSDFLDAALD

SEQ ID NO: 71 - protein, 27 aa, Artificial Sequence
  Core polypeptide
LAEAGEESVTEDTEREDTEEEREDEEE

SEQ ID NO: 72 - protein, 35 aa, Artificial Sequence
  Core polypeptide
ALLAEAGEESVTEDTEREDTEEEREDEEEENEART

SEQ ID NO: 73 - protein, 35 aa, Artificial Sequence
  Core polypeptide
ETERSVDLVAALLAEAGEESVTEDTEREDTEEERE

SEQ ID NO: 74 - protein, 28 aa, Artificial Sequence
  Core polypeptide
EESVTEDTEREDTEEEREDEEEENEART

SEQ ID NO: 75 - protein, 28 aa, Artificial Sequence
  Core polypeptide
VDLVAALLAEAGEESVTEDTEREDTEEE

SEQ ID NO: 76 - protein, 25 aa, Artificial Sequence
  Core polypeptide
NSETERSVDLVAALLAEAGEESVTE

SEQ ID NO: 77 - protein, 28 aa, Artificial Sequence
  Core polypeptide
DISYAQLQFTYDVLKDYINDALRNIMDA

SEQ ID NO: 78 - protein, 30 aa, Artificial Sequence
  Core polypeptide
SNVFSKDEIMREYNSQKQHIRTLSAKVNDN

SEQ ID NO: 79 - protein, 35 aa, Artificial Sequence
  Core polypeptide
IDISIELNKAKSDLEEAKEWIKKANQKLDSIGNWH

SEQ ID NO: 80 - protein, 35 aa, Artificial Sequence
  Core polypeptide
IDISIELNKAKSDLEESKEWIKKANQKLDSIGNWH

SEQ ID NO: 81 - protein, 39 aa, Artificial Sequence
  Core polypeptide
YESTQKAFDGITNKVNSVIEKTNTQFEAVGKEFGNLEKR

SEQ ID NO: 82 - protein, 28 aa, Artificial Sequence
  Core polypeptide
DEYDASISQVNEKINQSLAFIRKSDELL

SEQ ID NO: 83 - protein, 38 aa, Artificial Sequence
  Core polypeptide
VLHQLNIQLKQYLETQERLLAGNRIAARQLLQIWKDVA

SEQ ID NO: 84 - protein, 38 aa, Artificial Sequence
  Core polypeptide
LWHEQLLNTAQRAGLQLQLINQALAVREKVLIRYDIQK

SEQ ID NO: 85 - protein, 35 aa, Artificial Sequence
  Core polypeptide
LLDNFESTWEQSKELWEQQEISIQNLHKSALQEYW

SEQ ID NO: 86 - protein, 36 aa, Artificial Sequence
  Core polypeptide
LSNLLQISNNSDEWLEALEIEHEKWKLTQWQSYEQF

SEQ ID NO: 87 - protein, 36 aa, Artificial Sequence
  Core polypeptide
KLEALEGKLEALEGKLEALEGKLEALEGKLEALEGK

SEQ ID NO: 88 - protein, 29 aa, Artificial Sequence
  Core polypeptide
ELRALRGELRALRGELRALRGELRALRGK

SEQ ID NO: 89 - protein, 36 aa, Artificial Sequence
  Core polypeptide
ELKAKELEGEGLAEGEEALKGLLEKAAKLEGLELLK

SEQ ID NO: 90 - protein, 33 aa, Artificial Sequence
  Core polypeptide
MEWDREINNYTSLIHSLIEESQNQQEKNEQELL

SEQ ID NO: 91 - protein, 36 aa, Artificial Sequence
  Core polypeptide
YTSLIHSLIEESQNQQEKNEQELLELDKWASLWNAF

SEQ ID NO: 92 - protein, 36 aa, Artificial Sequence
  Core polypeptide
YTSLIHSLIEESQNQQEKNEQELLELDKWASLANWF

SEQ ID NO: 93 - protein, 36 aa, Artificial Sequence
  Core polypeptide
YTSLIHSLIEESQNQQEKNQQELLELDKWASLWNWF

SEQ ID NO: 94 - protein, 36 aa, Artificial Sequence
  Core polypeptide
YTSLIHSLIEESQNQQEKNEQELLQLDKWASLWNWF

SEQ ID NO: 95 - protein, 36 aa, Artificial Sequence
  Core polypeptide
YTSLIHSLIEESQNQQEKNQQELLQLDKWASLWNWF

SEQ ID NO: 96 - protein, 33 aa, Artificial Sequence
  Core polypeptide
RMKQLEDKVEELLSKNYHLENEVARLKKLVGER

SEQ ID NO: 97 - protein, 28 aa, Artificial Sequence
  Core polypeptide
QQLLQLTVWGIKQLQARILAVERYLKNQ

SEQ ID NO: 98 - protein, 18 aa, Artificial Sequence
  Core polypeptide
NEQELLELDKWASLWNWF

SEQ ID NO: 99 - protein, 36 aa, Artificial Sequence
  Core polypeptide
YTSLIQSLIEESQNQQEKNEQELLELDKWASLWNWF

SEQ ID NO: 100 - protein, 35 aa, Artificial Sequence
  Core polypeptide
IINFYDPLVFPSDEFDASISQVNEKINQSLAFIRK

SEQ ID NO: 101 - protein, 35 aa, Artificial Sequence
  Core polypeptide
INFYDPLVFPSDEFDASISQVNEKINQSLAFIRKS

SEQ ID NO: 102 - protein, 35 aa, Artificial Sequence
  Core polypeptide
NFYDPLVFPSDEFDASISQVNEKINQSLAFIRKSD

SEQ ID NO: 103 - protein, 35 aa, Artificial Sequence
  Core polypeptide
FYDPLVFPSDEFDASISQVNEKINQSLAFIRKSDE

SEQ ID NO: 104 - protein, 35 aa, Artificial Sequence
  Core polypeptide
YDPLVFPSDEFDASISQVNEKINQSLAFIRKSDEL

SEQ ID NO: 105 - protein, 35 aa, Artificial Sequence
  Core polypeptide
DPLVFPSDEFDASISQVNEKINQSLAFIRKSDELL

SEQ ID NO: 106 - protein, 35 aa, Artificial Sequence
  Core polypeptide
PLVFPSDEFDASISQVNEKINQSLAFIRKSDELLH

SEQ ID NO: 107 - protein, 35 aa, Artificial Sequence
  Core polypeptide
LVFPSDEFDASISQVNEKINQSLAFIRKSDELLHN

SEQ ID NO: 108 - protein, 35 aa, Artificial Sequence
  Core polypeptide
VFPSDEFDASISQVNEKINQSLAFIRKSDELLHNV

SEQ ID NO: 109 - protein, 35 aa, Artificial Sequence
  Core polypeptide
FPSDEFDASISQVNEKINQSLAFIRKSDELLHNVN

SEQ ID NO: 110 - protein, 35 aa, Artificial Sequence
  Core polypeptide
PSDEFDASISQVNEKINQSLAFIRKSDELLHNVNA

SEQ ID NO: 111 - protein, 35 aa, Artificial Sequence
  Core polypeptide
SDEFDASISQVNEKINQSLAFIRKSDELLHNVNAG

SEQ ID NO: 112 - protein, 35 aa, Artificial Sequence
  Core polypeptide
DEFDASISQVNEKINQSLAFIRKSDELLHNVNAGK

SEQ ID NO: 113 - protein, 35 aa, Artificial Sequence
  Core polypeptide
EFDASISQVNEKINQSLAFIRKSDELLHNVNAGKS

SEQ ID NO: 114 - protein, 35 aa, Artificial Sequence
  Core polypeptide
FDASISQVNEKINQSLAFIRKSDELLHNVNAGKST

SEQ ID NO: 115 - protein, 35 aa, Artificial Sequence
  Core polypeptide
DASISQVNEKINQSLAFIRKSDELLHNVNAGKSTT

SEQ ID NO: 116 - protein, 35 aa, Artificial Sequence
  Core polypeptide
ASGVAVSKVLHLEGEVNKIKSALLSTNKAVVSLSN

SEQ ID NO: 117 - protein, 35 aa, Artificial Sequence; identical to SEQ ID NO: 24
  Core polypeptide

SEQ ID NO: 118 - protein, 35 aa, Artificial Sequence
  Core polypeptide
GVAVSKVLHLEGEVNKIKSALLSTNKAVVSLSNGV

SEQ ID NO: 119 - protein, 35 aa, Artificial Sequence
  Core polypeptide
VAVSKVLHLEGEVNKIKSALLSTNKAVVSLSNGVS

SEQ ID NO: 120 - protein, 35 aa, Artificial Sequence
  Core polypeptide
AVSKVLHLEGEVNKIKSALLSTNKAVVSLSNGVSV

SEQ ID NO: 121 - protein, 35 aa, Artificial Sequence
  Core polypeptide
VSKVLHLEGEVNKIKSALLSTNKAVVSLSNGVSVL

SEQ ID NO: 122 - protein, 35 aa, Artificial Sequence
  Core polypeptide
SKVLHLEGEVNKIKSALLSTNKAVVSLSNGVSVLT

SEQ ID NO: 123 - protein, 35 aa, Artificial Sequence
  Core polypeptide
KVLHLEGEVNKIKSALLSTNKAVVSLSNGVSVLTS

SEQ ID NO: 124 - protein, 35 aa, Artificial Sequence
  Core polypeptide
VLHLEGEVNKIKSALLSTNKAVVSLSNGVSVLTSK

SEQ ID NO: 125 - protein, 35 aa, Artificial Sequence
  Core polypeptide
LHLEGEVNKIKSALLSTNKAVVSLSNGVSVLTSKV

SEQ ID NO: 126 - protein, 35 aa, Artificial Sequence
  Core polypeptide
HLEGEVNKIKSALLSTNKAVVSLSNGVSVLTSKVL

SEQ ID NO: 127 - protein, 35 aa, Artificial Sequence
  Core polypeptide
LEGEVNKIKSALLSTNKAVVSLSNGVSVLTSKVLD

SEQ ID NO: 128 - protein, 35 aa, Artificial Sequence
  Core polypeptide
EGEVNKIKSALLSTNKAVVSLSNGVSVLTSKVLDL

SEQ ID NO: 129 - protein, 35 aa, Artificial Sequence
  Core polypeptide
GEVNKIKSALLSTNKAVVSLSNGVSVLTSKVLDLK

SEQ ID NO: 130 - protein, 35 aa, Artificial Sequence
  Core polypeptide
EVNKIKSALLSTNKAVVSLSNGVSVLTSKVLDLKN

SEQ ID NO: 131 - protein, 35 aa, Artificial Sequence
  Core polypeptide
VNKIKSALLSTNKAVVSLSNGVSVLTSKVLDLKNY

SEQ ID NO: 132 - protein, 35 aa, Artificial Sequence
  Core polypeptide
NKIKSALLSTNKAVVSLSNGVSVLTSKVLDLKNYI

SEQ ID NO: 133 - protein, 35 aa, Artificial Sequence
  Core polypeptide
KIKSALLSTNKAVVSLSNGVSVLTSKVLDLKNYID

SEQ ID NO: 134 - protein, 35 aa, Artificial Sequence
  Core polypeptide
IKSALLSTNKAVVSLSNGVSVLTSKVLDLKNYIDK

SEQ ID NO: 135 - protein, 35 aa, Artificial Sequence
  Core polypeptide
KSALLSTNKAVVSLSNGVSVLTSKVLDLKNYIDKQ

SEQ ID NO: 136 - protein, 35 aa, Artificial Sequence
  Core polypeptide
SALLSTNKAVVSLSNGVSVLTSKVLDLKNYIDKQL

SEQ ID NO: 137 - protein, 35 aa, Artificial Sequence
  Core polypeptide
ALLSTNKAVVSLSNGVSVLTSKVLDLKNYIDKQLL

SEQ ID NO: 138 - protein, 35 aa, Artificial Sequence
  Core polypeptide
YTSVITIELSNIKENKCNGTDAKVKLIKQELDKYK

SEQ ID NO: 139 - protein, 35 aa, Artificial Sequence
  Core polypeptide
TSVITIELSNIKENKCNGTDAKVKLIKQELDKYKN

SEQ ID NO: 140 - protein, 35 aa, Artificial Sequence
  Core polypeptide
SVITIELSNIKENKCNGTDAKVKLIKQELDKYKNA

SEQ ID NO: 141 - protein, 35 aa, Artificial Sequence
  Core polypeptide
VITIELSNIKENKCNGTDAKVKLIKQELDKYKNAV

SEQ ID NO: 142 - protein, 35 aa, Artificial Sequence
  Core polypeptide
ITIELSNIKENKCNGTDAKVKLIKQELDKYKNAVT

SEQ ID NO: 143 - protein, 35 aa, Artificial Sequence
  Core polypeptide
TIELSNIKENKCNGTDAKVKLIKQELDKYKNAVTE

SEQ ID NO: 144 - protein, 35 aa, Artificial Sequence
  Core polypeptide
IELSNIKENKCNGTDAKVKLIKQELDKYKNAVTEL

SEQ ID NO: 145 - protein, 35 aa, Artificial Sequence
  Core polypeptide
ELSNIKENKCNGTDAKVKLIKQELDKYKNAVTELQ

SEQ ID NO: 146 - protein, 35 aa, Artificial Sequence
  Core polypeptide
LSNIKENKCNGTDAKVKLIKQELDKYKNAVTELQL

SEQ ID NO: 147 - protein, 35 aa, Artificial Sequence; identical to SEQ ID NO: 22
  Core polypeptide

SEQ ID NO: 148 - protein, 35 aa, Artificial Sequence
  Core polypeptide
NIKENKCNGTDAKVKLIKQELDKYKNAVTELQLLM

SEQ ID NO: 149 - protein, 35 aa, Artificial Sequence
  Core polypeptide
IKENKCNGTDAKVKLIKQELDKYKNAVTELQLLMQ

SEQ ID NO: 150 - protein, 35 aa, Artificial Sequence
  Core polypeptide
KENKCNGTDAKVKLIKQELDKYKNAVTELQLLMQS

SEQ ID NO: 151 - protein, 35 aa, Artificial Sequence
  Core polypeptide
ENKCNGTDAKVKLIKQELDKYKNAVTELQLLMQST

SEQ ID NO: 152 - protein, 36 aa, Artificial Sequence
  Core polypeptide
LLDNFESTWEQSKELWELQEISIQNLHKSALQEYWN

SEQ ID NO: 153 - protein, 35 aa, Artificial Sequence
  Core polypeptide
ALGVATSAQITAAVALVEAKQARSDIEKLKEAIRD

SEQ ID NO: 154 - protein, 35 aa, Artificial Sequence
  Core polypeptide
LGVATSAQITAAVALVEAKQARSDIEKLKEAIRDT

SEQ ID NO: 155 - protein, 35 aa, Artificial Sequence
  Core polypeptide
GVATSAQITAAVALVEAKQARSDIEKLKEAIRDTN

SEQ ID NO: 156 - protein, 35 aa, Artificial Sequence
  Core polypeptide
VATSAQITAAVALVEAKQARSDIEKLKEAIRDTNK

SEQ ID NO: 157 - protein, 35 aa, Artificial Sequence
  Core polypeptide
ATSAQITAAVALVEAKQARSDIEKLKEAIRDTNKA

SEQ ID NO: 158 - protein, 35 aa, Artificial Sequence
  Core polypeptide
TSAQITAAVALVEAKQARSDIEKLKEAIRDTNKAV

SEQ ID NO: 159 - protein, 35 aa, Artificial Sequence
  Core polypeptide
SAQITAAVALVEAKQARSDIEKLKEAIRDTNKAVQ

SEQ ID NO: 160 - protein, 35 aa, Artificial Sequence
  Core polypeptide
AQITAAVALVEAKQARSDIEKLKEAIRDTNKAVQS

SEQ ID NO: 161 - protein, 35 aa, Artificial Sequence
  Core polypeptide
QITAAVALVEAKQARSDIEKLKEAIRDTNKAVQSV

SEQ ID NO: 162 - protein, 35 aa, Artificial Sequence
  Core polypeptide
ITAAVALVEAKQARSDIEKLKEAIRDTNKAVQSVQ

SEQ ID NO: 163 - protein, 35 aa, Artificial Sequence
  Core polypeptide
TAAVALVEAKQARSDIEKLKEAIRDTNKAVQSVQS

SEQ ID NO: 164 - protein, 35 aa, Artificial Sequence; identical to SEQ ID NO: 34
  Core polypeptide

SEQ ID NO: 165 - protein, 35 aa, Artificial Sequence
  Core polypeptide
AVALVEAKQARSDIEKLKEAIRDTNKAVQSVQSSI

SEQ ID NO: 166 - protein, 35 aa, Artificial Sequence
  Core polypeptide
VALVEAKQARSDIEKLKEAIRDTNKAVQSVQSSIG

SEQ ID NO: 167 - protein, 35 aa, Artificial Sequence
  Core polypeptide
ALVEAKQARSDIEKLKEAIRDTNKAVQSVQSSIGN

SEQ ID NO: 168 - protein, 35 aa, Artificial Sequence
  Core polypeptide
LVEAKQARSDIEKLKEAIRDTNKAVQSVQSSIGNL

SEQ ID NO: 169 - protein, 35 aa, Artificial Sequence
  Core polypeptide
VEAKQARSDIEKLKEAIRDTNKAVQSVQSSIGNLI

SEQ ID NO: 170 - protein, 35 aa, Artificial Sequence
  Core polypeptide
EAKQARSDIEKLKEAIRDTNKAVQSVQSSIGNLIV

SEQ ID NO: 171 - protein, 35 aa, Artificial Sequence
  Core polypeptide
KQARSDIEKLKEAIRDTNKAVQSVQSSIGNLIVAI

SEQ ID NO: 172 - protein, 34 aa, Artificial Sequence
  Core polypeptide
QARSDEKLKEAIRDTNKAVQSVQSSIGNLIVAIK

SEQ ID NO: 173 - protein, 35 aa, Artificial Sequence
  Core polypeptide
QARSDIEKLKEAIRDTNKAVQSVQSSIGNLIVAIK

SEQ ID NO: 174 - protein, 35 aa, Artificial Sequence
  Core polypeptide
ARSDIEKLKEAIRDTNKAVQSVQSSIGNLIVAIKS

SEQ ID NO: 175 - protein, 35 aa, Artificial Sequence
  Core polypeptide
RSDIEKLKEAIRDTNKAVQSVQSSIGNLIVAIKSV

SEQ ID NO: 176 - protein, 35 aa, Artificial Sequence
  Core polypeptide
SDIEKLKEAIRDTNKAVQSVQSSIGNLIVAIKSVQ

SEQ ID NO: 177 - protein, 35 aa, Artificial Sequence
  Core polypeptide
DIEKLKEAIRDTNKAVQSVQSSIGNLIVAIKSVQD

SEQ ID NO: 178 - protein, 35 aa, Artificial Sequence
  Core polypeptide
IEKLKEAIRDTNKAVQSVQSSIGNLIVAIKSVQDY

SEQ ID NO: 179 - protein, 35 aa, Artificial Sequence
  Core polypeptide
EKLKEAIRDTNKAVQSVQSSIGNLIVAIKSVQDYV

SEQ ID NO: 180 - protein, 35 aa, Artificial Sequence
  Core polypeptide
KLKEAIRDTNKAVQSVQSSIGNLIVAIKSVQDYVN

SEQ ID NO: 181 - protein, 35 aa, Artificial Sequence
  Core polypeptide
LKEAIRDTNKAVQSVQSSIGNLIVAIKSVQDYVNK

SEQ ID NO: 182 - protein, 35 aa, Artificial Sequence
  Core polypeptide
KEAIRDTNKAVQSVQSSIGNLIVAIKSVQDYVNKE

SEQ ID NO: 183 - protein, 35 aa, Artificial Sequence
  Core polypeptide
EAIRDTNKAVQSVQSSIGNLIVAIKSVQDYVNKEI

SEQ ID NO: 184 - protein, 35 aa, Artificial Sequence
  Core polypeptide
AIRDTNKAVQSVQSSIGNLIVAIKSVQDYVNKEIV

SEQ ID NO: 185 - protein, 34 aa, Artificial Sequence
  Core polypeptide
IRDTNKAVQSVQSSIGNLIVAIKSVQDYVNKEIV

SEQ ID NO: 186 - protein, 35 aa, Artificial Sequence
  Core polypeptide
YTPNDITLNNSVALDPIDISIELNKAKSDLEESKE

SEQ ID NO: 187 - protein, 35 aa, Artificial Sequence
  Core polypeptide
TPNDITLNNSVALDPIDISIELNKAKSDLEESKEW

SEQ ID NO: 188 - protein, 35 aa, Artificial Sequence
  Core polypeptide
PNDITLNNSVALDPIDISIELNKAKSDLEESKEWI

SEQ ID NO: 189 - protein, 35 aa, Artificial Sequence
  Core polypeptide
NDITLNNSVALDPIDISIELNKAKSDLEESKEWIR

SEQ ID NO: 190 - protein, 35 aa, Artificial Sequence
  Core polypeptide
DITLNNSVALDPIDISIELNKAKSDLEESKEWIRR

SEQ ID NO: 191 - protein, 35 aa, Artificial Sequence
  Core polypeptide
ITLNNSVALDPIDISIELNKAKSDLEESKEWIRRS

SEQ ID NO: 192 - protein, 35 aa, Artificial Sequence
  Core polypeptide
TLNNSVALDPIDISIELNKAKSDLEESKEWIRRSN

SEQ ID NO: 193 - protein, 35 aa, Artificial Sequence
  Core polypeptide
LNNSVALDPIDISIELNKAKSDLEESKEWIRRSNQ

SEQ ID NO: 194 - protein, 35 aa, Artificial Sequence
  Core polypeptide
NNSVALDPIDISIELNKAKSDLEESKEWIRRSNQK

SEQ ID NO: 195 - protein, 35 aa, Artificial Sequence
  Core polypeptide
NSVALDPIDISIELNKAKSDLEESKEWIRRSNQKL

SEQ ID NO: 196 - protein, 35 aa, Artificial Sequence
  Core polypeptide
SVALDPIDISIELNKAKSDLEESKEWIRRSNQKLD

SEQ ID NO: 197 - protein, 35 aa, Artificial Sequence
  Core polypeptide
VALDPIDISIELNKAKSDLEESKEWIRRSNQKLDS

SEQ ID NO: 198 - protein, 35 aa, Artificial Sequence
  Core polypeptide
ALDPIDISIELNKAKSDLEESKEWIRRSNQKLDSI

SEQ ID NO: 199 - protein, 35 aa, Artificial Sequence
  Core polypeptide
LDPIDISIELNKAKSDLEESKEWIRRSNQKLDSIG

SEQ ID NO: 200 - protein, 35 aa, Artificial Sequence
  Core polypeptide
DPIDISIELNKAKSDLEESKEWIRRSNQKLDSIGN

SEQ ID NO: 201 - protein, 35 aa, Artificial Sequence
  Core polypeptide
PIDISIELNKAKSDLEESKEWIRRSNQKLDSIGNW

SEQ ID NO: 202 - protein, 35 aa, Artificial Sequence
  Core polypeptide
IDISIELNKAKSDLEESKEWIRRSNQKLDSIGNWH

SEQ ID NO: 203 - protein, 35 aa, Artificial Sequence
  Core polypeptide
DISIELNKAKSDLEESKEWIRRSNQKLDSIGNWHQ

SEQ ID NO: 204 - protein, 35 aa, Artificial Sequence
  Core polypeptide
ISIELNKAKSDLEESKEWIRRSNQKLDSIGNWHQS

SEQ ID NO: 205 - protein, 35 aa, Artificial Sequence
  Core polypeptide
SIELNKAKSDLEESKEWIRRSNQKLDSIGNWHQSS

SEQ ID NO: 206 - protein, 35 aa, Artificial Sequence
  Core polypeptide
IELNKAKSDLEESKEWIRRSNQKLDSIGNWHQSST

SEQ ID NO: 207 - protein, 35 aa, Artificial Sequence
  Core polypeptide
ELNKAKSDLEESKEWIRRSNQKLDSIGNWHQSSTT

SEQ ID NO: 208 - protein, 36 aa, Artificial Sequence
  Core polypeptide
ELRALRGELRALRGELRALRGELRALRGELRALRGK

SEQ ID NO: 209 - protein, 36 aa, Artificial Sequence
  Core polypeptide
YTSLIHSLIEESQNQQQKNEQELLELDKWASLWNWF

SEQ ID NO: 210 - protein, 36 aa, Artificial Sequence
  Core polypeptide
YTSLIHSLIEESQNQQEKNEQELLELNKWASLWNWF

SEQ ID NO: 211 - protein, 36 aa, Artificial Sequence
  Core polypeptide
YTSLIHSLIEQSQNQQEKNEQELLELDKWASLWNWF

SEQ ID NO: 212 - protein, 36 aa, Artificial Sequence
  Core polypeptide
YTSLIHSLIQESQNQQEKNEQELLELDKWASLWNWF

SEQ ID NO: 213 - protein, 36 aa, Artificial Sequence
  Core polypeptide
YTSLIHSLIQQSQNQQQKNQQQLLQLNKWASLWNWF

SEQ ID NO: 214 - protein, 17 aa, Artificial Sequence
  Core polypeptide
EQELLELDKWASLWNWF

SEQ ID NO: 215 - protein, 16 aa, Artificial Sequence
  Core polypeptide
QELLELDKWASLWNWF

SEQ ID NO: 216 - protein, 15 aa, Artificial Sequence
  Core polypeptide
ELLELDKWASLWNWF

SEQ ID NO: 217 - protein, 14 aa, Artificial Sequence
  Core polypeptide
LLELDKWASLWNWF

SEQ ID NO: 218 - protein, 13 aa, Artificial Sequence
  Core polypeptide
LELDKWASLWNWF

SEQ ID NO: 219 - protein, 12 aa, Artificial Sequence
  Core polypeptide
ELDKWASLWNWF

SEQ ID NO: 220 - protein, 11 aa, Artificial Sequence
  Core polypeptide
LDKWASLWNWF

SEQ ID NO: 221 - protein, 10 aa, Artificial Sequence
  Core polypeptide
DKWASLWNWF

SEQ ID NO: 222 - protein, 9 aa, Artificial Sequence
  Core polypeptide
KWASLWNWF

SEQ ID NO: 223 - protein, 8 aa, Artificial Sequence
  Core polypeptide
WASLWNWF

SEQ ID NO: 224 - protein, 7 aa, Artificial Sequence
  Core polypeptide
ASLWNWF

SEQ ID NO: 225 - protein, 18 aa, Artificial Sequence
  Core polypeptide
YTSLIHSLIEESQNQQEK

SEQ ID NO: 226 - protein, 36 aa, Artificial Sequence
  Core polypeptide
YTSLIHSLIEESQNQQEKNEQELLELDKWASLANAA

SEQ ID NO: 227 - protein, 36 aa, Artificial Sequence
  Core polypeptide
YTSLIHSLIEESQNQQEKNEQQLLELDKWASLWNWF

SEQ ID NO: 228 - protein, 36 aa, Artificial Sequence
  Core polypeptide
YTSLIQSLIEESQNQQEKNQQELLELDKWASLWNWF

SEQ ID NO: 229 - protein, 14 aa, Artificial Sequence
  Core polypeptide
CLELDKWASLWNWF

SEQ ID NO: 230 - protein, 13 aa, Artificial Sequence
  Core polypeptide
LELDKFASLFNFF

SEQ ID NO: 231 - protein, 28 aa, Artificial Sequence
  Core polypeptide
EAAAREAAAREAAARLELDKWASLWNWF

SEQ ID NO: 232 - protein, 28 aa, Artificial Sequence
  Core polypeptide
RMKQLEDKVEELLSKLELDKWASLWNWF

SEQ ID NO: 233 - protein, 35 aa, Artificial Sequence
  Core polypeptide
PSLRDPISAEISIQALSYALGGDINKVLEKLGYSG

SEQ ID NO: 234 - protein, 35 aa, Artificial Sequence
  Core polypeptide
SLRDPISAEISIQALSYALGGDINKVLEKLGYSGG

SEQ ID NO: 235 - protein, 35 aa, Artificial Sequence
  Core polypeptide
LRDPISAEISIQALSYALGGDINKVLEKLGYSGGD

SEQ ID NO: 236 - protein, 35 aa, Artificial Sequence
  Core polypeptide
RDPISAEISIQALSYALGGDINKVLEKLGYSGGDL

SEQ ID NO: 237 - protein, 35 aa, Artificial Sequence
  Core polypeptide
DPISAEISIQALSYALGGDINKVLEKLGYSGGDLL

SEQ ID NO: 238 - protein, 35 aa, Artificial Sequence
  Core polypeptide
PISAEISIQALSYALGGDINKVLEKLGYSGGDLLG

SEQ ID NO: 239 - protein, 35 aa, Artificial Sequence
  Core polypeptide
ISAEISIQALSYALGGDINKVLEKLGYSGGDLLGI

SEQ ID NO: 240 - protein, 35 aa, Artificial Sequence
  Core polypeptide
SAEISIQALSYALGGDINKVLEKLGYSGGDLLGIL

SEQ ID NO: 241 - protein, 35 aa, Artificial Sequence
  Core polypeptide
AEISIQALSYALGGDINKVLEKLGYSGGDLLGILE

SEQ ID NO: 242 - protein, 35 aa, Artificial Sequence
  Core polypeptide
EISIQALSYALGGDINKVLEKLGYSGGDLLGILES

SEQ ID NO: 243 - protein, 35 aa, Artificial Sequence
  Core polypeptide
ISIQALSYALGGDINKVLEKLGYSGGDLLGILESR

SEQ ID NO: 244 - protein, 35 aa, Artificial Sequence
  Core polypeptide
SIQALSYALGGDINKVLEKLGYSGGDLLGILESRG

SEQ ID NO: 245 - protein, 35 aa, Artificial Sequence
  Core polypeptide
IQALSYALGGDINKVLEKLGYSGGDLLGILESRGI

SEQ ID NO: 246 - protein, 35 aa, Artificial Sequence
  Core polypeptide
QALSYALGGDINKVLEKLGYSGGDLLGILESRGIK

SEQ ID NO: 247 - protein, 35 aa, Artificial Sequence
  Core polypeptide
ALSYALGGDINKVLEKLGYSGGDLLGILESRGIKA

SEQ ID NO: 248 - protein, 35 aa, Artificial Sequence
  Core polypeptide
LSYALGGDINKVLEKLGYSGGDLLGILESRGIKAR

SEQ ID NO: 249 - protein, 35 aa, Artificial Sequence
  Core polypeptide
PDAVYLHRIDLGPPISLERLDVGTNLGNAIAKLED

SEQ ID NO: 250 - protein, 35 aa, Artificial Sequence
  Core polypeptide
DAVYLHRIDLGPPISLERLDVGTNLGNAIAKLEDA

SEQ ID NO: 251 - protein, 35 aa, Artificial Sequence
  Core polypeptide
AVYLHRIDLGPPISLERLDVGTNLGNAIAKLEDAK

SEQ ID NO: 252 - protein, 35 aa, Artificial Sequence
  Core polypeptide
VYLHRIDLGPPISLERLDVGTNLGNAIAKLEDAKE

SEQ ID NO: 253 - protein, 35 aa, Artificial Sequence
  Core polypeptide
YLHRIDLGPPISLERLDVGTNLGNAIAKLEDAKEL

SEQ ID NO: 254 - protein, 35 aa, Artificial Sequence
  Core polypeptide
LHRIDLGPPISLERLDVGTNLGNAIAKLEDAKELL

SEQ ID NO: 255 - protein, 35 aa, Artificial Sequence
  Core polypeptide
HRIDLGPPISLERLDVGTNLGNAIAKLEDAKELLE

SEQ ID NO: 256 - protein, 35 aa, Artificial Sequence
  Core polypeptide
RIDLGPPISLERLDVGTNLGNAIAKLEDAKELLES

SEQ ID NO: 257 - protein, 35 aa, Artificial Sequence
  Core polypeptide
IDLGPPISLERLDVGTNLGNAIAKLEDAKELLESS

SEQ ID NO: 258 - protein, 35 aa, Artificial Sequence
  Core polypeptide
DLGPPISLERLDVGTNLGNAIAKLEDAKELLESSD

SEQ ID NO: 259 - protein, 35 aa, Artificial Sequence
  Core polypeptide
LGPPISLERLDVGTNLGNAIAKLEDAKELLESSDQ

SEQ ID NO: 260 - protein, 35 aa, Artificial Sequence
  Core polypeptide
GPPISLERLDVGTNLGNAIAKLEDAKELLESSDQI

SEQ ID NO: 261 - protein, 35 aa, Artificial Sequence
  Core polypeptide
PPISLERLDVGTNLGNAIAKLEDAKELLESSDQIL

SEQ ID NO: 262 - protein, 35 aa, Artificial Sequence
  Core polypeptide
PISLERLDVGTNLGNAIAKLEDAKELLESSDQILR

SEQ ID NO: 263 - protein, 34 aa, Artificial Sequence
  Core polypeptide
ISLERLDVGTNLGNAIAKLEDAKELLESSDQIRS

SEQ ID NO: 264 - protein, 35 aa, Artificial Sequence
  Core polypeptide
SLERLDVGTNLGNAIAKLEDAKELLESSDQILRSM

SEQ ID NO: 265 - protein, 35 aa, Artificial Sequence
  Core polypeptide
LERLDVGTNLGNAIAKLEDAKELLESSDQILRSMK

SEQ ID NO: 266 - protein, 13 aa, Artificial Sequence
  Core polypeptide
EWIRRSNQKLDSI

SEQ ID NO: 267 - protein, 13 aa, Artificial Sequence
  Core polypeptide
LELDKWASLANAF

SEQ ID NO: 268 - protein, 13 aa, Artificial Sequence
  Core polypeptide
LELDKWASLFNFF

SEQ ID NO: 269 - protein, 13 aa, Artificial Sequence
  Core polypeptide
LELDKWASLANWF

SEQ ID NO: 270 - protein, 13 aa, Artificial Sequence
  Core polypeptide
LELDKWASLWNAF

SEQ ID NO: 271 - protein, 35 aa, Artificial Sequence
  Core polypeptide
ELGNVNNSISNALDKLEESNSKLDKVNVKLTSTSA

SEQ ID NO: 272 - protein, 35 aa, Artificial Sequence
  Core polypeptide
TELGNVNNSISNALDKLEESNSKLDKVNVKLTSTS

SEQ ID NO: 273 - protein, 35 aa, Artificial Sequence
  Core polypeptide
STELGNVNNSISNALDKLEESNSKLDKVNVKLTST

SEQ ID NO: 274 - protein, 35 aa, Artificial Sequence
  Core polypeptide
ISTELGNVNNSISNALDKLEESNSKLDKVNVKLTS

SEQ ID NO: 275 - protein, 35 aa, Artificial Sequence
  Core polypeptide
DISTELGNVNNSISNALDKLEESNSKLDKVNVKLT

SEQ ID NO: 276 - protein, 35 aa, Artificial Sequence
  Core polypeptide
LDISTELGNVNNSISNALDKLEESNSKLDKVNVKL

SEQ ID NO: 277 - protein, 35 aa, Artificial Sequence
  Core polypeptide
NLDISTELGNVNNSISNALDKLEESNSKLDKVNVK

SEQ ID NO: 278 - protein, 35 aa, Artificial Sequence
  Core polypeptide
GNLDISTELGNVNNSISNALDKLEESNSKLDKVNV

SEQ ID NO: 279 - protein, 35 aa, Artificial Sequence
  Core polypeptide
TGNLDISTELGNVNNSISNALDKLEESNSKLDKVN

SEQ ID NO: 280 - protein, 35 aa, Artificial Sequence
  Core polypeptide
VTGNLDISTELGNVNNSISNALDKLEESNSKLDKV

SEQ ID NO: 281 - protein, 35 aa, Artificial Sequence
  Core polypeptide
IVTGNLDISTELGNVNNSISNALDKLEESNSKLDK

SEQ ID NO: 282 - protein, 35 aa, Artificial Sequence
  Core polypeptide
VIVTGNLDISTELGNVNNSISNALDKLEESNSKLD

SEQ ID NO: 283 - protein, 35 aa, Artificial Sequence
  Core polypeptide
QVIVTGNLDISTELGNVNNSISNALDKLEESNSKL

SEQ ID NO: 284 - protein, 35 aa, Artificial Sequence
  Core polypeptide
SQVIVTGNLDISTELGNVNNSISNALDKLEESNSK

SEQ ID NO: 285 - protein, 35 aa, Artificial Sequence
  Core polypeptide
DSQVIVTGNLDISTELGNVNNSISNALDKLEESNS

SEQ ID NO: 286 - protein, 35 aa, Artificial Sequence
  Core polypeptide
LDSQVIVTGNLDISTELGNVNNSISNALDKLEESN

SEQ ID NO: 287 - protein, 35 aa, Artificial Sequence
  Core polypeptide
ILDSQVIVTGNLDISTELGNVNNSISNALDKLEES

SEQ ID NO: 288 - protein, 35 aa, Artificial Sequence
  Core polypeptide
SILDSQVIVTGNLDISTELGNVNNSISNALDKLEE

SEQ ID NO: 289 - protein, 35 aa, Artificial Sequence
  Core polypeptide
ISILDSQVIVTGNLDISTELGNVNNSISNALDKLE

SEQ ID NO: 290 - protein, 35 aa, Artificial Sequence
  Core polypeptide
NISILDSQVIVTGNLDISTELGNVNNSISNALDKL

SEQ ID NO: 291 - protein, 35 aa, Artificial Sequence
  Core polypeptide
KNISILDSQVIVTGNLDISTELGNVNNSISNALDK

SEQ ID NO: 292 - protein, 35 aa, Artificial Sequence
  Core polypeptide
QKNISILDSQVIVTGNLDISTELGNVNNSISNALD

SEQ ID NO: 293 - protein, 35 aa, Artificial Sequence
  Core polypeptide
YQKNISILDSQVIVTGNLDISTELGNVNNSISNAL

SEQ ID NO: 294 - protein, 35 aa, Artificial Sequence
  Core polypeptide
TYQKNISILDSQVIVTGNLDISTELGNVNNSISNA

SEQ ID NO: 295 - protein, 35 aa, Artificial Sequence
  Core polypeptide
ATYQKNISILDSQVIVTGNLDISTELGNVNNSISN

SEQ ID NO: 296 - protein, 35 aa, Artificial Sequence
  Core polypeptide
DATYQKNISILDSQVIVTGNLDISTELGNVNNSIS

SEQ ID NO: 297 - protein, 35 aa, Artificial Sequence
  Core polypeptide
FDATYQKNISILDSQVIVTGNLDISTELGNVNNSI

SEQ ID NO: 298 - protein, 35 aa, Artificial Sequence
  Core polypeptide
EFDATYQKNISILDSQVIVTGNLDISTELGNVNNS

SEQ ID NO: 299 - protein, 35 aa, Artificial Sequence
  Core polypeptide
GEFDATYQKNISILDSQVIVTGNLDISTELGNVNN

SEQ ID NO: 300 - protein, 35 aa, Artificial Sequence
  Core polypeptide
SGEFDATYQKNISILDSQVIVTGNLDISTELGNVN

SEQ ID NO: 301 - protein, 35 aa, Artificial Sequence
  Core polypeptide
LSGEFDATYQKNISILDSQVIVTGNLDISTELGNV

SEQ ID NO: 302 - protein, 35 aa, Artificial Sequence
  Core polypeptide
RLSGEFDATYQKNISILDSQVIVTGNLDISTELGN

SEQ ID NO: 303 - protein, 35 aa, Artificial Sequence
  Core polypeptide
LRLSGEFDATYQKNISILDSQVIVTGNLDISTELG

SEQ ID NO: 304 - protein, 35 aa, Artificial Sequence
  Core polypeptide
TLRLSGEFDATYQKNISILDSQVIVTGNLDISTEL

SEQ ID NO: 305 - protein, 35 aa, Artificial Sequence
  Core polypeptide
ITLRLSGEFDATYQKNISILDSQVIVTGNLDISTE

SEQ ID NO: 306 - protein, 35 aa, Artificial Sequence
  Core polypeptide
GITLRLSGEFDATYQKNISILDSQVIVTGNLDIST

SEQ ID NO: 307 - protein, 35 aa, Artificial Sequence
  Core polypeptide
TATIEAVHEVTDGLSQLAVAVGKMQQFVNDQFNNT

SEQ ID NO: 308 - protein, 35 aa, Artificial Sequence
  Core polypeptide
ITATIEAVHEVTDGLSQLAVAVGKMQQFVNDQFNN

SEQ ID NO: 309 - protein, 35 aa, Artificial Sequence
  Core polypeptide
SITATIEAVHEVTDGLSQLAVAVGKMQQFVNDQFN

SEQ ID NO: 310 - protein, 35 aa, Artificial Sequence
  Core polypeptide
KESITATIEAVHEVTDGLSQLAVAVGKMQQFVNDQ

SEQ ID NO: 311 - protein, 35 aa, Artificial Sequence
  Core polypeptide
LKESITATIEAVHEVTDGLSQLAVAVGKMQQFVND

SEQ ID NO: 312 - protein, 35 aa, Artificial Sequence
  Core polypeptide
RLKESITATIEAVHEVTDGLSQLAVAVGKMQQFVN

SEQ ID NO: 313 - protein, 35 aa, Artificial Sequence
  Core polypeptide
LRLKESITATIEAVHEVTDGLSQLAVAVGKMQQFV

SEQ ID NO: 314 - protein, 35 aa, Artificial Sequence
  Core polypeptide
ILRLKESITATIEAVHEVTDGLSQLAVAVGKMQQF

SEQ ID NO: 315 - protein, 35 aa, Artificial Sequence
  Core polypeptide
NILRLKESITATIEAVHEVTDGLSQLAVAVGKMQQ

SEQ ID NO: 316 - protein, 35 aa, Artificial Sequence
  Core polypeptide
ANILRLKESITATIEAVHEVTDGLSQLAVAVGKMQ

SEQ ID NO: 317 - protein, 35 aa, Artificial Sequence
  Core polypeptide
AANILRLKESITATIEAVHEVTDGLSQLAVAVGKM

SEQ ID NO: 318 - protein, 35 aa, Artificial Sequence
  Core polypeptide
HKCDDECMNSVKNGTYDYPKYEEESKLNRNEIKGV

SEQ ID NO: 319 - protein, 35 aa, Artificial Sequence
  Core polypeptide
KCDDECMNSVKNGTYDYPKYEEESKLNRNEIKGVK

SEQ ID NO: 320 - protein, 35 aa, Artificial Sequence
  Core polypeptide
CDDECMNSVKNGTYDYPKYEEESKLNRNEIKGVKL

SEQ ID NO: 321 - protein, 35 aa, Artificial Sequence
  Core polypeptide
DDECMNSVKNGTYDYPKYEEESKLNRNEIKGVKLS

SEQ ID NO: 322 - protein, 35 aa, Artificial Sequence
  Core polypeptide
DECMNSVKNGTYDYPKYEEESKLNRNEIKGVKLSS

SEQ ID NO: 323 - protein, 35 aa, Artificial Sequence
  Core polypeptide
ECMNSVKNGTYDYPKYEEESKLNRNEIKGVKLSSM

SEQ ID NO: 324 - protein, 35 aa, Artificial Sequence
  Core polypeptide
CMNSVKNGTYDYPKYEEESKLNRNEIKGVKLSSMG

SEQ ID NO: 325 - protein, 35 aa, Artificial Sequence
  Core polypeptide
MNSVKNGTYDYPKYEEESKLNRNEIKGVKLSSMGV

SEQ ID NO: 326 - protein, 35 aa, Artificial Sequence
  Core polypeptide
NSVKNGTYDYPKYEEESKLNRNEIKGVKLSSMGVY

SEQ ID NO: 327 - protein, 35 aa, Artificial Sequence
  Core polypeptide
SVKNGTYDYPKYEEESKLNRNEIKGVKLSSMGVYQ

SEQ ID NO: 328 - protein, 35 aa, Artificial Sequence
  Core polypeptide
VKNGTYDYPKYEEESKLNRNEIKGVKLSSMGVYQI

SEQ ID NO: 329 - protein, 35 aa, Artificial Sequence
  Core polypeptide
KNGTYDYPKYEEESKLNRNEIKGVKLSSMGVYQIL

SEQ ID NO: 330 - protein, 13 aa, Artificial Sequence
  Core polypeptide
AFIRKSDELLHNV

SEQ ID NO: 331 - protein, 35 aa, Artificial Sequence
  Core polypeptide
VVLAGAALGVATAAQITAGIALHQSMLNSQAIDNL

SEQ ID NO: 332 - protein, 35 aa, Artificial Sequence
  Core polypeptide
VLAGAALGVATAAQITAGIALHQSMLNSQAIDNLR

SEQ ID NO: 333 - protein, 35 aa, Artificial Sequence
  Core polypeptide
LAGAALGVATAAQITAGIALHQSMLNSQAIDNLRA

SEQ ID NO: 334 - protein, 35 aa, Artificial Sequence
  Core polypeptide
AGAALGVATAAQITAGIALHQSMLNSQAIDNLRAS

SEQ ID NO: 335 - protein, 35 aa, Artificial Sequence
  Core polypeptide
GAALGVATAAQITAGIALHQSMLNSQAIDNLRASL

SEQ ID NO: 336 - protein, 35 aa, Artificial Sequence
  Core polypeptide
AALGVATAAQITAGIALHQSMLNSQAIDNLRASLE

SEQ ID NO: 337 - protein, 35 aa, Artificial Sequence
  Core polypeptide
ALGVATAAQITAGIALHQSMLNSQAIDNLRASLET

SEQ ID NO: 338 - protein, 35 aa, Artificial Sequence
  Core polypeptide
LGVATAAQITAGIALHQSMLNSQAIDNLRASLETT

SEQ ID NO: 339 - protein, 35 aa, Artificial Sequence
  Core polypeptide
GVATAAQITAGIALHQSMLNSQAIDNLRASLETTN

SEQ ID NO: 340 - protein, 35 aa, Artificial Sequence
  Core polypeptide
VATAAQITAGIALHQSMLNSQAIDNLRASLETTNQ

SEQ ID NO: 341 - protein, 35 aa, Artificial Sequence
  Core polypeptide
ATAAQITAGIALHQSMLNSQAIDNLRASLETTNQA

SEQ ID NO: 342 - protein, 35 aa, Artificial Sequence
  Core polypeptide
TAAQITAGIALHQSMLNSQAIDNLRASLETTNQAI

SEQ ID NO: 343 - protein, 35 aa, Artificial Sequence
  Core polypeptide
AAQITAGIALHQSMLNSQAIDNLRASLETTNQAIE

SEQ ID NO: 344 - protein, 35 aa, Artificial Sequence
  Core polypeptide
AQITAGIALHQSMLNSQAIDNLRASLETTNQAIEA

SEQ ID NO: 345 - protein, 35 aa, Artificial Sequence
  Core polypeptide
QITAGIALHQSMLNSQAIDNLRASLETTNQAIEAI

SEQ ID NO: 346 - protein, 35 aa, Artificial Sequence
  Core polypeptide
ITAGIALHQSMLNSQAIDNLRASLETTNQAIEAIR

SEQ ID NO: 347 - protein, 35 aa, Artificial Sequence
  Core polypeptide
TAGIALHQSMLNSQAIDNLRASLETTNQAIEAIRQ

SEQ ID NO: 348 - protein, 35 aa, Artificial Sequence
  Core polypeptide
AGIALHQSMLNSQAIDNLRASLETTNQAIEAIRQA

SEQ ID NO: 349 - protein, 35 aa, Artificial Sequence
  Core polypeptide
GIALHQSMLNSQAIDNLRASLETTNQAIEAIRQAG

SEQ ID NO: 350 - protein, 35 aa, Artificial Sequence
  Core polypeptide
IALHQSMLNSQAIDNLRASLETTNQAIEAIRQAGQ

SEQ ID NO: 351 - protein, 35 aa, Artificial Sequence
  Core polypeptide
ALHQSMLNSQAIDNLRASLETTNQAIEAIRQAGQE

SEQ ID NO: 352 - protein, 35 aa, Artificial Sequence
  Core polypeptide
LHQSMLNSQAIDNLRASLETTNQAIEAIRQAGQEM

SEQ ID NO: 353 - protein, 35 aa, Artificial Sequence
  Core polypeptide
HQSMLNSQAIDNLRASLETTNQAIEAIRQAGQEMI

SEQ ID NO: 354 - protein, 35 aa, Artificial Sequence
  Core polypeptide
QSMLNSQAIDNLRASLETTNQAIEAIRQAGQEMIL

SEQ ID NO: 355 - protein, 35 aa, Artificial Sequence
  Core polypeptide
SMLNSQAIDNLRASLETTNQAIEAIRQAGQEMILA

SEQ ID NO: 356 - protein, 35 aa, Artificial Sequence
  Core polypeptide
MLNSQAIDNLRASLETTNQAIEAIRQAGQEMILAV

SEQ ID NO: 357 - protein, 35 aa, Artificial Sequence
  Core polypeptide
LNSQAIDNLRASLETTNQAIEAIRQAGQEMILAVQ

SEQ ID NO: 358 - protein, 35 aa, Artificial Sequence
  Core polypeptide
NSQAIDNLRASLETTNQAIEAIRQAGQEMILAVQG

SEQ ID NO: 359 - protein, 35 aa, Artificial Sequence
  Core polypeptide
SQAIDNLRASLETTNQAIEAIRQAGQEMILAVQGV

SEQ ID NO: 360 - protein, 35 aa, Artificial Sequence
  Core polypeptide
QAIDNLRASLETTNQAIEAIRQAGQEMILAVQGVQ

SEQ ID NO: 361 - protein, 35 aa, Artificial Sequence
  Core polypeptide
AIDNLRASLETTNQAIEAIRQAGQEMILAVQGVQD

SEQ ID NO: 362 - protein, 35 aa, Artificial Sequence
  Core polypeptide
IDNLRASLETTNQAIEAIRQAGQEMILAVQGVQDY

SEQ ID NO: 363 - protein, 35 aa, Artificial Sequence
  Core polypeptide
DNLRASLETTNQAIEAIRQAGQEMILAVQGVQDYI

SEQ ID NO: 364 - protein, 35 aa, Artificial Sequence
  Core polypeptide
NLRASLETTNQAIEAIRQAGQEMILAVQGVQDYIN

SEQ ID NO: 365 - protein, 35 aa, Artificial Sequence
  Core polypeptide
LRASLETTNQAIEAIRQAGQEMILAVQGVQDYINN

SEQ ID NO: 366 - protein, 35 aa, Artificial Sequence
  Core polypeptide
RASLETTNQAIEAIRQAGQEMILAVQGVQDYINNE

SEQ ID NO: 367 - protein, 33 aa, Artificial Sequence
  Core polypeptide
YTSVITIELSNIKENKNGTDAVKLIKQELDKYK

SEQ ID NO: 368 - protein, 33 aa, Artificial Sequence
  Core polypeptide
TSVITIELSNIKENKNGTDAVKLIKQELDKYKN

SEQ ID NO: 369 - protein, 33 aa, Artificial Sequence
  Core polypeptide
SVITIELSNIKENKNGTDAVKLIKQELDKYKNA

SEQ ID NO: 370 - protein, 34 aa, Artificial Sequence
  Core polypeptide
SNIKENKNGTDAKVKLIKQELDKYKNAVTELQLL

SEQ ID NO: 371 - protein, 34 aa, Artificial Sequence
  Core polypeptide
KENKNGTDAKVKLIKQELDKYKNAVTELQLLMQS

SEQ ID NO: 372 - protein, 15 aa, Artificial Sequence
  Core polypeptide
CLELDKWASLWNWFC

SEQ ID NO: 373 - protein, 15 aa, Artificial Sequence
  Core polypeptide
CLELDKWASLANWFC

SEQ ID NO: 374 - protein, 15 aa, Artificial Sequence
  Core polypeptide
CLELDKWASLFNFFC

SEQ ID NO: 375 - protein, 36 aa, Artificial Sequence
  Core polypeptide
YTSLIHSLIEESQNQQEKNEQELLELDKWASLFNFF

SEQ ID NO: 376 - protein, 35 aa, Artificial Sequence
  Core polypeptide
RMKQLEDKVEELLSKNYHLENELELDKWASLWNWF

SEQ ID NO: 377 - protein, 28 aa, Artificial Sequence
  Core polypeptide
KVEELLSKNYHLENELELDKWASLWNWF

SEQ ID NO: 378 - protein, 29 aa, Artificial Sequence
  Core polypeptide
RMKQLEDKVEELLSKLEWIRRSNQKLDSI

SEQ ID NO: 379 - protein, 29 aa, Artificial Sequence
  Core polypeptide
RMKQLEDKVEELLSKLAFIRKSDELLHNV

SEQ ID NO: 380 - protein, 28 aa, Artificial Sequence
  Core polypeptide
ELEALRGELRALRGELELDKWASLWNWF

SEQ ID NO: 381 - protein, 34 aa, Artificial Sequence
  Core polypeptide
LDPIDISIELNKAKSDLEESKEWIRRSNQKLDSI

SEQ ID NO: 382 - protein, 16 aa, Artificial Sequence
  Core polypeptide
CNEQLSDSFPVEFFQV

SEQ ID NO: 383 - protein, 21 aa, Artificial Sequence
  Core polypeptide
MAEDDPYLGRPEQMFHLDPSL

SEQ ID NO: 384 - protein, 20 aa, Artificial Sequence
  Core polypeptide
EDFSSIADMDFSALLSQISS

SEQ ID NO: 385 - protein, 35 aa, Artificial Sequence
  Core polypeptide
TWQEWERKVDFLEENITALLEEAQIQQEKNMYELQ

SEQ ID NO: 386 - protein, 35 aa, Artificial Sequence
  Core polypeptide
WQEWERKVDFLEENITALLEEAQIQQEKNMYELQK

SEQ ID NO: 387 - protein, 35 aa, Artificial Sequence
  Core polypeptide
QEWERKVDFLEENITALLEEAQIQQEKNMYELQKL

SEQ ID NO: 388 - protein, 35 aa, Artificial Sequence
  Core polypeptide
EWERKVDFLEENITALLEEAQIQQEKNMYELQKLN

SEQ ID NO: 389 - protein, 35 aa, Artificial Sequence
  Core polypeptide
WERKVDFLEENITALLEEAQIQQEKNMYELQKLNS

SEQ ID NO: 390 - protein, 35 aa, Artificial Sequence
  Core polypeptide
ERKVDFLEENITALLEEAQIQQEKNMYELQKLNSW

SEQ ID NO: 391 - protein, 35 aa, Artificial Sequence
  Core polypeptide
RKVDFLEENITALLEEAQIQQEKNMYELQKLNSWD

SEQ ID NO: 392 - protein, 35 aa, Artificial Sequence
  Core polypeptide
KVDFLEENITALLEEAQIQQEKNMYELQKLNSWDV

SEQ ID NO: 393 - protein, 35 aa, Artificial Sequence
  Core polypeptide
VDFLEENITALLEEAQIQQEKNMYELQKLNSWDVF

SEQ ID NO: 394 - protein, 35 aa, Artificial Sequence
  Core polypeptide
DFLEENITALLEEAQIQQEKNMYELQKLNSWDVFG

SEQ ID NO: 395 - protein, 35 aa, Artificial Sequence
  Core polypeptide
FLEENITALLEEAQIQQEKNMYELQKLNSWDVFGN

SEQ ID NO: 396 - protein, 35 aa, Artificial Sequence
  Core polypeptide
LEENITALLEEAQIQQEKNMYELQKLNSWDVFGNW

SEQ ID NO: 397 - protein, 36 aa, Artificial Sequence
  Core polypeptide
LEENITALLEEAQIQQEKNMYELQKLNSWDVFGNWF

SEQ ID NO: 398 - protein, 36 aa, Artificial Sequence
  Core polypeptide
NEQSEEKENELYWAKEQLLDLLFNIFNQTVGAWIMQ

SEQ ID NO: 399 - protein, 33 aa, Artificial Sequence
  Core polypeptide
EWERKVDFLEENITALLEEAQIQQEKNMYEGGC

SEQ ID NO: 400 - protein, 38 aa, Artificial Sequence
  Core polypeptide
QQQLLDVVKRQQELLRLTVWGTKNLQTRVTAIEKYLKD

SEQ ID NO: 401 - protein, 38 aa, Artificial Sequence
  Core polypeptide
QQLLDVVKRQQELLRLTVWGTKNLQTRVTAIEKYLKDQ

SEQ ID NO: 402 - protein, 38 aa, Artificial Sequence
  Core polypeptide
QQLLDVVKRQQELLRLTVWGPKNLQTRVTAIEKYLKDQ

SEQ ID NO: 403 - protein, 38 aa, Artificial Sequence
  Core polypeptide
DERKQDKVLVVQQTGTLQLTLIQLEKTAKLQWVRLNRY

SEQ ID NO: 404 - protein, 35 aa, Artificial Sequence
  Core polypeptide
QQQLLDVVKRQQELLRLTVWGTKNLQTRVTAIEKY

SEQ ID NO: 405 - protein, 35 aa, Artificial Sequence
  Core polypeptide
QQLLDVVKRQQELLRLTVWGTKNLQTRVTAIEKYL

SEQ ID NO: 406 - protein, 35 aa, Artificial Sequence
  Core polypeptide
QLLDVVKRQQELLRLTVWGTKNLQTRVTAIEKYLK

SEQ ID NO: 407 - protein, 35 aa, Artificial Sequence
  Core polypeptide
LLDVVKRQQELLRLTVWGTKNLQTRVTAIEKYLKD

SEQ ID NO: 408 - protein, 35 aa, Artificial Sequence
  Core polypeptide
LDVVKRQQELLRLTVWGTKNLQTRVTAIEKYLKDQ

SEQ ID NO: 409 - protein, 35 aa, Artificial Sequence
  Core polypeptide
DVVKRQQELLRLTVWGTKNLQTRVTAIEKYLKDQA

SEQ ID NO: 410 - protein, 35 aa, Artificial Sequence
  Core polypeptide
VVKRQQELLRLTVWGTKNLQTRVTAIEKYLKDQAQ

SEQ ID NO: 411 - protein, 35 aa, Artificial Sequence
  Core polypeptide
VKRQQELLRLTVWGTKNLQTRVTAIEKYLKDQAQL

SEQ ID NO: 412 - protein, 35 aa, Artificial Sequence
  Core polypeptide
KRQQELLRLTVWGTKNLQTRVTAIEKYLKDQAQLN

SEQ ID NO: 413 - protein, 35 aa, Artificial Sequence
  Core polypeptide
RQQELLRLTVWGTKNLQTRVTAIEKYLKDQAQLNA

SEQ ID NO: 414 - protein, 35 aa, Artificial Sequence
  Core polypeptide
QQELLRLTVWGTKNLQTRVTAIEKYLKDQAQLNAW

SEQ ID NO: 415 - protein, 35 aa, Artificial Sequence
  Core polypeptide
QELLRLTVWGTKNLQTRVTAIEKYLKDQAQLNAWG

SEQ ID NO: 416 - protein, 35 aa, Artificial Sequence
  Core polypeptide
ELLRLTVWGTKNLQTRVTAIEKYLKDQAQLNAWGC

SEQ ID NO: 417 - protein, 38 aa, Artificial Sequence
  Core polypeptide
NNLLRAIEAQQHLLQLTVWGPKQLQARILAVERYLKDQ

SEQ ID NO: 418 - protein, 35 aa, Artificial Sequence
  Core polypeptide
SELEIKRYKNRVASRKCRAKFKQLLQHYREVAAAK

SEQ ID NO: 419 - protein, 35 aa, Artificial Sequence
  Core polypeptide
ELEIKRYKNRVASRKCRAKFKQLLQHYREVAAAKS

SEQ ID NO: 420 - protein, 35 aa, Artificial Sequence
  Core polypeptide
LEIKRYKNRVASRKCRAKFKQLLQHYREVAAAKSS

SEQ ID NO: 421 - protein, 35 aa, Artificial Sequence
  Core polypeptide
EIKRYKNRVASRKCRAKFKQLLQHYREVAAAKSSE

SEQ ID NO: 422 - protein, 35 aa, Artificial Sequence
  Core polypeptide
IKRYKNRVASRKCRAKFKQLLQHYREVAAAKSSEN

SEQ ID NO: 423 - protein, 35 aa, Artificial Sequence
  Core polypeptide
KRYKNRVASRKCRAKFKQLLQHYREVAAAKSSEND

SEQ ID NO: 424 - protein, 35 aa, Artificial Sequence
  Core polypeptide
RYKNRVASRKCRAKFKQLLQHYREVAAAKSSENDR

SEQ ID NO: 425 - protein, 35 aa, Artificial Sequence
  Core polypeptide
YKNRVASRKCRAKFKQLLQHYREVAAAKSSENDRL

SEQ ID NO: 426 - protein, 35 aa, Artificial Sequence
  Core polypeptide
KNRVASRKCRAKFKQLLQHYREVAAAKSSENDRLR

SEQ ID NO: 427 - protein, 35 aa, Artificial Sequence
  Core polypeptide
NRVASRKCRAKFKQLLQHYREVAAAKSSENDRLRL

SEQ ID NO: 428 - protein, 35 aa, Artificial Sequence
  Core polypeptide
RVASRKCRAKFKQLLQHYREVAAAKSSENDRLRLL

SEQ ID NO: 429 - protein, 35 aa, Artificial Sequence
  Core polypeptide
VASRKCRAKFKQLLQHYREVAAAKSSENDRLRLLL

SEQ ID NO: 430 - protein, 35 aa, Artificial Sequence
  Core polypeptide
ASRKCRAKFKQLLQHYREVAAAKSSENDRLRLLLK

SEQ ID NO: 431 - protein, 35 aa, Artificial Sequence
  Core polypeptide
SRKCRAKFKQLLQHYREVAAAKSSENDRLRLLLKQ

SEQ ID NO: 432 - protein, 35 aa, Artificial Sequence
  Core polypeptide
RKCRAKFKQLLQHYREVAAAKSSENDRLRLLLKQM

SEQ ID NO: 433 - protein, 35 aa, Artificial Sequence
  Core polypeptide
KCRAKFKQLLQHYREVAAAKSSENDRLRLLLKQMC

SEQ ID NO: 434 - protein, 35 aa, Artificial Sequence
  Core polypeptide
CRAKFKQLLQHYREVAAAKSSENDRLRLLLKQMCP

SEQ ID NO: 435 - protein, 35 aa, Artificial Sequence
  Core polypeptide
RAKFKQLLQHYREVAAAKSSENDRLRLLLKQMCPS

SEQ ID NO: 436 - protein, 35 aa, Artificial Sequence
  Core polypeptide
AKFKQLLQHYREVAAAKSSENDRLRLLLKQMCPSL

SEQ ID NO: 437 - protein, 35 aa, Artificial Sequence
  Core polypeptide
KFKQLLQHYREVAAAKSSENDRLRLLLKQMCPSLD

SEQ ID NO: 438 - protein, 35 aa, Artificial Sequence
  Core polypeptide
FKQLLQHYREVAAAKSSENDRLRLLLKQMCPSLDV

SEQ ID NO: 439 - protein, 35 aa, Artificial Sequence
  Core polypeptide
KQLLQHYREVAAAKSSENDRLRLLLKQMCPSLDVD

SEQ ID NO: 440 - protein, 35 aa, Artificial Sequence
  Core polypeptide
QLLQHYREVAAAKSSENDRLRLLLKQMCPSLDVDS

SEQ ID NO: 441 - protein, 35 aa, Artificial Sequence
  Core polypeptide
LLQHYREVAAAKSSENDRLRLLLKQMCPSLDVDSI

SEQ ID NO: 442 - protein, 35 aa, Artificial Sequence
  Core polypeptide
LQHYREVAAAKSSENDRLRLLLKQMCPSLDVDSII

SEQ ID NO: 443 - protein, 35 aa, Artificial Sequence
  Core polypeptide
QHYREVAAAKSSENDRLRLLLKQMCPSLDVDSIIP

SEQ ID NO: 444 - protein, 35 aa, Artificial Sequence
  Core polypeptide
HYREVAAAKSSENDRLRLLLKQMCPSLDVDSIIPR

SEQ ID NO: 445 - protein, 35 aa, Artificial Sequence
  Core polypeptide
YREVAAAKSSENDRLRLLLKQMCPSLDVDSIIPRT

SEQ ID NO: 446 - protein, 35 aa, Artificial Sequence
  Core polypeptide
REVAAAKSSENDRLRLLLKQMCPSLDVDSIIPRTP

SEQ ID NO: 447 - protein, 35 aa, Artificial Sequence
  Core polypeptide
EVAAAKSSENDRLRLLLKQMCPSLDVDSIIPRTPD

SEQ ID NO: 448 - protein, 35 aa, Artificial Sequence
  Core polypeptide
VAAAKSSENDRLRLLLKQMCPSLDVDSIIPRTPDV

SEQ ID NO: 449 - protein, 35 aa, Artificial Sequence
  Core polypeptide
AAAKSSENDRLRLLLKQMCPSLDVDSIIPRTPDVL

SEQ ID NO: 450 - protein, 35 aa, Artificial Sequence
  Core polypeptide
AAKSSENDRLRLLLKQMCPSLDVDSIIPRTPDVLH

SEQ ID NO: 451 - protein, 35 aa, Artificial Sequence
  Core polypeptide
AKSSENDRLRLLLKQMCPSLDVDSIIPRTPDVLHE

SEQ ID NO: 452 - protein, 35 aa, Artificial Sequence
  Core polypeptide
KSSENDRLRLLLKQMCPSLDVDSIIPRTPDVLHED

SEQ ID NO: 453 - protein, 35 aa, Artificial Sequence
  Core polypeptide
SSENDRLRLLLKQMCPSLDVDSIIPRTPDVLHEDL

SEQ ID NO: 454 - protein, 35 aa, Artificial Sequence
  Core polypeptide
SENDRLRLLLKQMCPSLDVDSIIPRTPDVLHEDLL

SEQ ID NO: 455 - protein, 35 aa, Artificial Sequence
  Core polypeptide
ENDRLRLLLKQMCPSLDVDSIIPRTPDVLHEDLLN

SEQ ID NO: 456 - protein, 35 aa, Artificial Sequence
  Core polypeptide
NDRLRLLLKQMCPSLDVDSIIPRTPDVLHEDLLNF

SEQ ID NO: 457 - protein, 35 aa, Artificial Sequence
  Core polypeptide
AAGSTMGARSMTLTVQARQLLSGIVQQQNNLLRAI

SEQ ID NO: 458 - protein, 35 aa, Artificial Sequence
  Core polypeptide
PGYRWMCLRRFIIFLFILLLCLIFLLVLLDYQGML

SEQ ID NO: 459 - protein, 35 aa, Artificial Sequence
  Core polypeptide
GYRWMCLRRFIIFLFILLLCLIFLLVLLDYQGMLP

SEQ ID NO: 460 - protein, 35 aa, Artificial Sequence
  Core polypeptide
YRWMCLRRFIIFLFILLLCLIFLLVLLDYQGMLPV

SEQ ID NO: 461 - protein, 35 aa, Artificial Sequence
  Core polypeptide
RWMCLRRFIIFLFILLLCLIFLLVLLDYQGMLPVC

SEQ ID NO: 462 - protein, 35 aa, Artificial Sequence
  Core polypeptide
WMCLRRFIIFLFILLLCLIFLLVLLDYQGMLPVCP

SEQ ID NO: 463 - protein, 35 aa, Artificial Sequence
  Core polypeptide
MCLRRFIIFLFILLLCLIFLLVLLDYQGMLPVCPL

SEQ ID NO: 464 - protein, 35 aa, Artificial Sequence
  Core polypeptide
CLRRFIIFLFILLLCLIFLLVLLDYQGMLPVCPLI

SEQ ID NO: 465 - protein, 35 aa, Artificial Sequence
  Core polypeptide
LRRFIIFLFILLLCLIFLLVLLDYQGMLPVCPLIP

SEQ ID NO: 466 - protein, 35 aa, Artificial Sequence
  Core polypeptide
RRFIIFLFILLLCLIFLLVLLDYQGMLPVCPLIPG

SEQ ID NO: 467 - protein, 35 aa, Artificial Sequence
  Core polypeptide
RFIIFLFILLLCLIFLLVLLDYQGMLPVCPLIPGS

SEQ ID NO: 468 - protein, 35 aa, Artificial Sequence
  Core polypeptide
FIIFLFILLLCLIFLLVLLDYQGMLPVCPLIPGSS

SEQ ID NO: 469 - protein, 35 aa, Artificial Sequence
  Core polypeptide
IIFLFILLLCLIFLLVLLDYQGMLPVCPLIPGSST

SEQ ID NO: 470 - protein, 35 aa, Artificial Sequence
  Core polypeptide
IFLFILLLCLIFLLVLLDYQGMLPVCPLIPGSSTT

SEQ ID NO: 471 - protein, 35 aa, Artificial Sequence
  Core polypeptide
FLFILLLCLIFLLVLLDYQGMLPVCPLIPGSSTTS

SEQ ID NO: 472 - protein, 35 aa, Artificial Sequence
  Core polypeptide
LFILLLCLIFLLVLLDYQGMLPVCPLIPGSSTTST

SEQ ID NO: 473 - protein, 35 aa, Artificial Sequence
  Core polypeptide
FILLLCLIFLLVLLDYQGMLPVCPLIPGSSTTSTG

SEQ ID NO: 474 - protein, 35 aa, Artificial Sequence
  Core polypeptide
ILLLCLIFLLVLLDYQGMLPVCPLIPGSSTTSTGP

SEQ ID NO: 475 - protein, 35 aa, Artificial Sequence
  Core polypeptide
LLLCLIFLLVLLDYQGMLPVCPLIPGSSTTSTGPC

SEQ ID NO: 476 - protein, 35 aa, Artificial Sequence
  Core polypeptide
LLCLIFLLVLLDYQGMLPVCPLIPGSSTTSTGPCR

SEQ ID NO: 477 - protein, 35 aa, Artificial Sequence
  Core polypeptide
LCLIFLLVLLDYQGMLPVCPLIPGSSTTSTGPCRT

SEQ ID NO: 478 - protein, 35 aa, Artificial Sequence
  Core polypeptide
CLIFLLVLLDYQGMLPVCPLIPGSSTTSTGPCRTC

SEQ ID NO: 479 - protein, 35 aa, Artificial Sequence
  Core polypeptide
LIFLLVLLDYQGMLPVCPLIPGSSTTSTGPCRTCM

SEQ ID NO: 480 - protein, 35 aa, Artificial Sequence
  Core polypeptide
IFLLVLLDYQGMLPVCPLIPGSSTTSTGPCRTCMT

SEQ ID NO: 481 - protein, 35 aa, Artificial Sequence
  Core polypeptide
FLLVLLDYQGMLPVCPLIPGSSTTSTGPCRTCMTT

SEQ ID NO: 482 - protein, 35 aa, Artificial Sequence
  Core polypeptide
PLLVLQAGFFLLTRILTIPQSLDSWWTSLNFLGGT

SEQ ID NO: 483 - protein, 35 aa, Artificial Sequence
  Core polypeptide
LLVLQAGFFLLTRILTIPQSLDSWWTSLNFLGGTT

SEQ ID NO: 484 - protein, 35 aa, Artificial Sequence
  Core polypeptide
LVLQAGFFLLTRILTIPQSLDSWWTSLNFLGGTTV

SEQ ID NO: 485 - protein, 35 aa, Artificial Sequence
  Core polypeptide
VLQAGFFLLTRILTIPQSLDSWWTSLNFLGGTTVC

SEQ ID NO: 486 - protein, 35 aa, Artificial Sequence
  Core polypeptide
LQAGFFLLTRILTIPQSLDSWWTSLNFLGGTTVCL

SEQ ID NO: 487 - protein, 35 aa, Artificial Sequence
  Core polypeptide
QAGFFLLTRILTIPQSLDSWWTSLNFLGGTTVCLG

SEQ ID NO: 488 - protein, 35 aa, Artificial Sequence
  Core polypeptide
AGFFLLTRILTIPQSLDSWWTSLNFLGGTTVCLGQ

SEQ ID NO: 489 - protein, 35 aa, Artificial Sequence
  Core polypeptide
GFFLLTRILTIPQSLDSWWTSLNFLGGTTVCLGQN

SEQ ID NO: 490 - protein, 35 aa, Artificial Sequence
  Core polypeptide
FFLLTRILTIPQSLDSWWTSLNFLGGTTVCLGQNS

SEQ ID NO: 491 - protein, 35 aa, Artificial Sequence
  Core polypeptide
FLLTRILTIPQSLDSWWTSLNFLGGTTVCLGQNSQ

SEQ ID NO: 492 - protein, 35 aa, Artificial Sequence
  Core polypeptide
LLTRILTIPQSLDSWWTSLNFLGGTTVCLGQNSQS

SEQ ID NO: 493 - protein, 35 aa, Artificial Sequence
  Core polypeptide
LTRILTIPQSLDSWWTSLNFLGGTTVCLGQNSQSP

SEQ ID NO: 494 - protein, 28 aa, Artificial Sequence
  Core polypeptide
FWNWLSAWKDLELKSLLEEVKDELQKMR

SEQ ID NO: 495 - protein, 19 aa, Artificial Sequence
  Core polypeptide
NNLLRAIEAQQHLLQLTVW

SEQ ID NO: 496 - protein, 41 aa, Artificial Sequence
  Core polypeptide
CGGNNLLRAIEAQQHLLQLTVWGIKQLQARILAVERYLKDQ

SEQ ID NO: 497 - protein, 36 aa, Artificial Sequence; identical to SEQ ID NO: 15
  Core polypeptide

SEQ ID NO: 498 - protein, 36 aa, Artificial Sequence; identical to SEQ ID NO: 15
  Core polypeptide

SEQ ID NO: 499 - protein, 35 aa, Artificial Sequence
  Core polypeptide
AVSKGYLSALRTGWYTSVITIELSNIKENKNGTDA

SEQ ID NO: 500 - protein, 36 aa, Artificial Sequence
  Core polypeptide
SISNIETVIEFQQKNNRLLEITREFSVNAGVTTPVS

SEQ ID NO: 501 - protein, 35 aa, Artificial Sequence
  Core polypeptide
DQQIKQYKRLLDRLIIPLYDGLRQKDVIVSNQESN

SEQ ID NO: 502 - protein, 36 aa, Artificial Sequence
  Core polypeptide
YSELTNIFGDNIGSLQEKGIKLQGIASLYRTNITEI

SEQ ID NO: 503 - protein, 36 aa, Artificial Sequence
  Core polypeptide
TSITLQVRLPLLTRLLNTQIYRVDSISYNIQNREWY

SEQ ID NO: 504 - protein, 35 aa, Artificial Sequence
  Core polypeptide
VEIAEYRRLLRTVLEPIRDALNAMTQNIRPVQSVA

SEQ ID NO: 505 - protein, 36 aa, Artificial Sequence
  Core polypeptide
SYFIVLSIAYPTLSEIKGVIVHRLEGVSYNIGSQEW

SEQ ID NO: 506 - protein, 28 aa, Artificial Sequence
  Core polypeptide
LKEAIRDTNKAVQSVQSSIGNLIVAIKS

SEQ ID NO: 507 - protein, 38 aa, Artificial Sequence; identical to SEQ ID NO: 16
  Core polypeptide

SEQ ID NO: 508 - protein, 16 aa, Artificial Sequence
  Core polypeptide
QKQEPIDKELYPLTSL

SEQ ID NO: 509 - protein, 14 aa, Artificial Sequence
  Core polypeptide
YPKFVKQNTLKLAT

SEQ ID NO: 510 - protein, 14 aa, Artificial Sequence
  Core polypeptide
QYIKANQKFIGITE

SEQ ID NO: 511 - protein, 14 aa, Artificial Sequence
  Core polypeptide
NGQIGNDPNRDILY

SEQ ID NO: 512 - protein, 6 aa, Artificial Sequence
  Core polypeptide
RPDVYH

SEQ ID NO: 513 - protein, 15 aa, Artificial Sequence
  Core polypeptide
CLELDKWASLWNWFC

SEQ ID NO: 514 - protein, 15 aa, Artificial Sequence
  Core polypeptide
CLELDKWASLANWFC

SEQ ID NO: 515 - protein, 15 aa, Artificial Sequence
  Core polypeptide
CLELDKWASLANFFC

SEQ ID NO: 516 - protein, 39 aa, Artificial Sequence
  Core polypeptide
NNLLRAIEAQQQHLLQLTVWGIKQLQARILAVERYLKDQ

SEQ ID NO: 517 - protein, 39 aa, Artificial Sequence
  Core polypeptide
CGGYTSLIHSLIEESQNQQEKNEQELLELDKWASLWNWF

SEQ ID NO: 518 - protein, 35 aa, Artificial Sequence; identical to SEQ ID NO: 482
  Core polypeptide

SEQ ID NO: 519 - protein, 35 aa, Artificial Sequence; identical to SEQ ID NO: 483
  Core polypeptide

SEQ ID NO: 520 - protein, 35 aa, Artificial Sequence; identical to SEQ ID NO: 484
  Core polypeptide

SEQ ID NO: 521 - protein, 35 aa, Artificial Sequence; identical to SEQ ID NO: 485
  Core polypeptide

SEQ ID NO: 522 - protein, 35 aa, Artificial Sequence; identical to SEQ ID NO: 486
  Core polypeptide

SEQ ID NO: 523 - protein, 35 aa, Artificial Sequence; identical to SEQ ID NO: 487
  Core polypeptide

SEQ ID NO: 524 - protein, 35 aa, Artificial Sequence; identical to SEQ ID NO: 488
  Core polypeptide

SEQ ID NO: 525 - protein, 35 aa, Artificial Sequence; identical to SEQ ID NO: 489
  Core polypeptide

SEQ ID NO: 526 - protein, 35 aa, Artificial Sequence; identical to SEQ ID NO: 490
  Core polypeptide

SEQ ID NO: 527 - protein, 35 aa, Artificial Sequence; identical to SEQ ID NO: 491
  Core polypeptide

SEQ ID NO: 528 - protein, 35 aa, Artificial Sequence; identical to SEQ ID NO: 492
  Core polypeptide

SEQ ID NO: 529 - protein, 35 aa, Artificial Sequence; identical to SEQ ID NO: 493
  Core polypeptide

SEQ ID NO: 530 - protein, 13 aa, Artificial Sequence
  Core polypeptide
LELDKWASLWNWA

SEQ ID NO: 531 - protein, 13 aa, Artificial Sequence
  Core polypeptide
LELDKWASAWNWF

SEQ ID NO: 532 - protein, 13 aa, Artificial Sequence
  Core polypeptide
LELDKAASLWNWF

SEQ ID NO: 533 - protein, 13 aa, Artificial Sequence
  Core polypeptide
LKLDKWASLWNWF

SEQ ID NO: 534 - protein, 13 aa, Artificial Sequence
  Core polypeptide
LELKKWASLWNWF

SEQ ID NO: 535 - protein, 13 aa, Artificial Sequence
  Core polypeptide
DELLHNVNAGKST

SEQ ID NO: 536 - protein, 15 aa, Artificial Sequence
  Core polypeptide
KSDELLHNVNAGKST

SEQ ID NO: 537 - protein, 17 aa, Artificial Sequence
  Core polypeptide
IRKSDELLHNVNAGKST

SEQ ID NO: 538 - protein, 19 aa, Artificial Sequence
  Core polypeptide
AFIRKSDELLHNVNAGKST

SEQ ID NO: 539 - protein, 19 aa, Artificial Sequence
  Core polypeptide
FDASISQVNEKINQSLAFI

SEQ ID NO: 540 - protein, 36 aa, Artificial Sequence
  Core polypeptide
YAADKESTQKAFDGITNKVNSVIEKMNTQFEAVGKE

SEQ ID NO: 541 - protein, 36 aa, Artificial Sequence
  Core polypeptide
SVIEKMNTQFEAVGKEFGNLERRLENLNKRMEDGFL

SEQ ID NO: 542 - protein, 36 aa, Artificial Sequence
  Core polypeptide
VWTYNAELLVLMENERTLDFHDSNVKNLYDKVRMQL

SEQ ID NO: 543 - protein, 33 aa, Artificial Sequence
  Core polypeptide
EWDREINNYTSLIHSLIEESQNQQEKNEQEGGC

SEQ ID NO: 544 - protein, 35 aa, Artificial Sequence
  Core polypeptide
INNYTSLIHSLIEESQNQQEKNEQELLELDKWASL

SEQ ID NO: 545 - protein, 28 aa, Artificial Sequence
  Core polypeptide
INNYTSLIHSLIEESQNQQEKNEQELLE

SEQ ID NO: 546 - protein, 35 aa, Artificial Sequence
  Core polypeptide
WMEWDREINNYTSLIHSLIEESQNQQEKNEQELLE

SEQ ID NO: 547 - protein, 48 aa, Artificial Sequence
  Core polypeptide
MTWMEWDREINNYTSLIHSLIEESQNQQEKNEQELLELDKWASLWNWF

SEQ ID NO: 548 - protein, 35 aa, Artificial Sequence
  Core polypeptide
IDISIELNKAKSDLEESKEWIKKSNQKLDSIGNWH

SEQ ID NO: 549 - protein, 36 aa, Artificial Sequence
  Core polypeptide
NQQEKNEQELLELDKWASLWNWFNITNWLWYIKIFI

SEQ ID NO: 550 - protein, 36 aa, Artificial Sequence
  Core polypeptide
QNQQEKNEQELLELDKWASLWNWFNITNWLWYIKIF

SEQ ID NO: 551 - protein, 36 aa, Artificial Sequence
  Core polypeptide
SQNQQEKNEQELLELDKWASLWNWFNITNWLWYIKI

SEQ ID NO: 552 - protein, 36 aa, Artificial Sequence
  Core polypeptide
ESQNQQEKNEQELLELDKWASLWNWFNITNWLWYIK

SEQ ID NO: 553 - protein, 36 aa, Artificial Sequence
  Core polypeptide
EESQNQQEKNEQELLELDKWASLWNWFNITNWLWYI

SEQ ID NO: 554 - protein, 36 aa, Artificial Sequence
  Core polypeptide
IEESQNQQEKNEQELLELDKWASLWNWFNITNWLWY

SEQ ID NO: 555 - protein, 36 aa, Artificial Sequence
  Core polypeptide
LIEESQNQQEKNEQELLELDKWASLWNWFNITNWLW

SEQ ID NO: 556 - protein, 36 aa, Artificial Sequence
  Core polypeptide
SLIEESQNQQEKNEQELLELDKWASLWNWFNITNWL

SEQ ID NO: 557 - protein, 36 aa, Artificial Sequence
  Core polypeptide
HSLIEESQNQQEKNEQELLELDKWASLWNWFNITNW

SEQ ID NO: 558 - protein, 36 aa, Artificial Sequence
  Core polypeptide
IHSLIEESQNQQEKNEQELLELDKWASLWNWFNITN

SEQ ID NO: 559 - protein, 36 aa, Artificial Sequence
  Core polypeptide
LIHSLIEESQNQQEKNEQELLELDKWASLWNWFNIT

SEQ ID NO: 560 - protein, 36 aa, Artificial Sequence
  Core polypeptide
SLIHSLIEESQNQQEKNEQELLELDKWASLWNWFNI

SEQ ID NO: 561 - protein, 36 aa, Artificial Sequence
  Core polypeptide
TSLIHSLIEESQNQQEKNEQELLELDKWASLWNWFN

SEQ ID NO: 562 - protein, 36 aa, Artificial Sequence
  Core polypeptide
NYTSLIHSLIEESQNQQEKNEQELLELDKWASLWNW

SEQ ID NO: 563 - protein, 36 aa, Artificial Sequence
  Core polypeptide
NNYTSLIHSLIEESQNQQEKNEQELLELDKWASLWN

SEQ ID NO: 564 - protein, 36 aa, Artificial Sequence
  Core polypeptide
INNYTSLIHSLIEESQNQQEKNEQELLELDKWASLW

SEQ ID NO: 565 - protein, 36 aa, Artificial Sequence
  Core polypeptide
EINNYTSLIHSLIEESQNQQEKNEQELLELDKWASL

SEQ ID NO: 566 - protein, 36 aa, Artificial Sequence
  Core polypeptide
REINNYTSLIHSLIEESQNQQEKNEQELLELDKWAS

SEQ ID NO: 567 - protein, 36 aa, Artificial Sequence
  Core polypeptide
DREINNYTSLIHSLIEESQNQQEKNEQELLELDKWA

SEQ ID NO: 568 - protein, 36 aa, Artificial Sequence
  Core polypeptide
WDREINNYTSLIHSLIEESQNQQEKNEQELLELDKW

SEQ ID NO: 569 - protein, 36 aa, Artificial Sequence
  Core polypeptide
EWDREINNYTSLIHSLIEESQNQQEKNEQELLELDK

SEQ ID NO: 570 - protein, 38 aa, Artificial Sequence
  Core polypeptide
MEWDREINNYTSLIHSLIEESQNQQEKNEQELLELDNH

SEQ ID NO: 571 - protein, 36 aa, Artificial Sequence
  Core polypeptide
MEWDREINNYTSLIHSLIEESQNQQEKNEQELLELD

SEQ ID NO: 572 - protein, 36 aa, Artificial Sequence
  Core polypeptide
WMEWDREINNYTSLIHSLIEESQNQQEKNEQELLEL

SEQ ID NO: 573 - protein, 36 aa, Artificial Sequence
  Core polypeptide
TWMEWDREINNYTSLIHSLIEESQNQQEKNEQELLE

SEQ ID NO: 574 - protein, 36 aa, Artificial Sequence
  Core polypeptide
MTWMEWDREINNYTSLIHSLIEESQNQQEKNEQELL

SEQ ID NO: 575 - protein, 36 aa, Artificial Sequence
  Core polypeptide
NMTWMEWDREINNYTSLIHSLIEESQNQQEKNEQEL

SEQ ID NO: 576 - protein, 36 aa, Artificial Sequence
  Core polypeptide
NNMTWMEWDREINNYTSLIHSLIEESQNQQEKNEQE

SEQ ID NO: 577 - protein, 36 aa, Artificial Sequence
  Core polypeptide
WNNMTWMEWDREINNYTSLIHSLIEESQNQQEKNEQ

SEQ ID NO: 578 - protein, 36 aa, Artificial Sequence
  Core polypeptide
IWNNMTWMEWDREINNYTSLIHSLIEESQNQQEKNE

SEQ ID NO: 579 - protein, 36 aa, Artificial Sequence
  Core polypeptide
QIWNNMTWMEWDREINNYTSLIHSLIEESQNQQEKN

SEQ ID NO: 580 - protein, 36 aa, Artificial Sequence
  Core polypeptide
EQIWNNMTWMEWDREINNYTSLIHSLIEESQNQQEK

SEQ ID NO: 581 - protein, 36 aa, Artificial Sequence
  Core polypeptide
LEQIWNNMTWMEWDREINNYTSLIHSLIEESQNQQE

SEQ ID NO: 582 - protein, 36 aa, Artificial Sequence
  Core polypeptide
SLEQIWNNMTWMEWDREINNYTSLIHSLIEESQNQQ

SEQ ID NO: 583 - protein, 36 aa, Artificial Sequence
  Core polypeptide
KSLEQIWNNMTWMEWDREINNYTSLIHSLIEESQNQ

SEQ ID NO: 584 - protein, 36 aa, Artificial Sequence
  Core polypeptide
NKSLEQIWNNMTWMEWDREINNYTSLIHSLIEESQN

SEQ ID NO: 585 - protein, 21 aa, Artificial Sequence
  Core polypeptide
SLAFIRKSDELLHNVNAGKST

SEQ ID NO: 586 - protein, 21 aa, Artificial Sequence
  Core polypeptide
FDASISQVNEKINQSLAFIRK

SEQ ID NO: 587 - protein, 36 aa, Artificial Sequence
  Core polypeptide
YTSLIHSLIEESQQQQEKQEQELLELDKWASLWNWF

SEQ ID NO: 588 - protein, 33 aa, Artificial Sequence
  Core polypeptide
FDASISQVNEKINQSLAFIRKSDELLHNVNAGK

SEQ ID NO: 589 - protein, 31 aa, Artificial Sequence
  Core polypeptide
FDASISQVNEKINQSLAFIRKSDELLHNVNA

SEQ ID NO: 590 - protein, 29 aa, Artificial Sequence
  Core polypeptide
FDASISQVNEKINQSLAFIRKSDELLHNV

SEQ ID NO: 591 - protein, 27 aa, Artificial Sequence
  Core polypeptide
FDASISQVNEKINQSLAFIRKSDELLH

SEQ ID NO: 592 - protein, 25 aa, Artificial Sequence
  Core polypeptide
FDASISQVNEKINQSLAFIRKSDEL

SEQ ID NO: 593 - protein, 23 aa, Artificial Sequence
  Core polypeptide
FDASISQVNEKINQSLAFIRKSD

SEQ ID NO: 594 - protein, 33 aa, Artificial Sequence
  Core polypeptide
ASISQVNEKINQSLAFIRKSDELLHNVNAGKST

SEQ ID NO: 595 - protein, 31 aa, Artificial Sequence
  Core polypeptide
ISQVNEKINQSLAFIRKSDELLHNVNAGKST

SEQ ID NO: 596 - protein, 29 aa, Artificial Sequence
  Core polypeptide
QVNEKINQSLAFIRKSDELLHNVNAGKST

SEQ ID NO: 597 - protein, 27 aa, Artificial Sequence
  Core polypeptide
NEKINQSLAFIRKSDELLHNVNAGKST

SEQ ID NO: 598 - protein, 25 aa, Artificial Sequence
  Core polypeptide
KINQSLAFIRKSDELLHNVNAGKST

SEQ ID NO: 599 - protein, 23 aa, Artificial Sequence
  Core polypeptide
NQSLAFIRKSDELLHNVNAGKST

SEQ ID NO: 600 - protein, 30 aa, Artificial Sequence
  Core polypeptide
FWNWLSAWKDLELYPGSLELDKWASLWNWF

SEQ ID NO: 601 - protein, 41 aa, Artificial Sequence; identical to SEQ ID NO: 496
  Core polypeptide

SEQ ID NO: 602 - protein, 39 aa, Artificial Sequence; identical to SEQ ID NO: 517
  Core polypeptide

SEQ ID NO: 603 - protein, 36 aa, Artificial Sequence; identical to SEQ ID NO: 15
  Core polypeptide

SEQ ID NO: 604 - protein, 38 aa, Artificial Sequence; identical to SEQ ID NO: 16
  Core polypeptide

SEQ ID NO: 605 - protein, 36 aa, Artificial Sequence
  Core polypeptide
EKNMYELQKLNSWDVFTNWLDFTSWVRYIQYIQYGV

SEQ ID NO: 606 - protein, 36 aa, Artificial Sequence
  Core polypeptide
QEKNMYELQKLNSWDVFTNWLDFTSWVRYIQYIQYG

SEQ ID NO: 607 - protein, 36 aa, Artificial Sequence
  Core polypeptide
QQEKNMYELQKLNSWDVFTNWLDFTSWVRYIQYIQY

SEQ ID NO: 608 - protein, 36 aa, Artificial Sequence
  Core polypeptide
IQQEKNMYELQKLNSWDVFTNWLDFTSWVRYIQYIQ

SEQ ID NO: 609 - protein, 36 aa, Artificial Sequence
  Core polypeptide
QIQQEKNMYELQKLNSWDVFTNWLDFTSWVRYIQYI

SEQ ID NO: 610 - protein, 36 aa, Artificial Sequence
  Core polypeptide
AQIQQEKNMYELQKLNSWDVFTNWLDFTSWVRYIQY

SEQ ID NO: 611 - protein, 36 aa, Artificial Sequence
  Core polypeptide
QAQIQQEKNMYELQKLNSWDVFTNWLDFTSWVRYIQ

SEQ ID NO: 612 - protein, 36 aa, Artificial Sequence
  Core polypeptide
EQAQIQQEKNMYELQKLNSWDVFTNWLDFTSWVRYI

SEQ ID NO: 613 - protein, 36 aa, Artificial Sequence
  Core polypeptide
LEQAQIQQEKNMYELQKLNSWDVFTNWLDFTSWVRY

SEQ ID NO: 614 - protein, 36 aa, Artificial Sequence
  Core polypeptide
SLEQAQIQQEKNMYELQKLNSWDVFTNWLDFTSWVR

SEQ ID NO: 615 - protein, 36 aa, Artificial Sequence
  Core polypeptide
QSLEQAQIQQEKNMYELQKLNSWDVFTNWLDFTSWV

SEQ ID NO: 616 - protein, 36 aa, Artificial Sequence
  Core polypeptide
SQSLEQAQIQQEKNMYELQKLNSWDVFTNWLDFTSW

SEQ ID NO: 617 - protein, 36 aa, Artificial Sequence
  Core polypeptide
ISQSLEQAQIQQEKNMYELQKLNSWDVFTNWLDFTS

SEQ ID NO: 618 - protein, 36 aa, Artificial Sequence
  Core polypeptide
NISQSLEQAQIQQEKNMYELQKLNSWDVFTNWLDFT

SEQ ID NO: 619 - protein, 36 aa, Artificial Sequence
  Core polypeptide
ANISQSLEQAQIQQEKNMYELQKLNSWDVFTNWLDF

SEQ ID NO: 620 - protein, 36 aa, Artificial Sequence
  Core polypeptide
EANISQSLEQAQIQQEKNMYELQKLNSWDVFTNWLD

SEQ ID NO: 621 - protein, 36 aa, Artificial Sequence
  Core polypeptide
LEANISQSLEQAQIQQEKNMYELQKLNSWDVFTNWL

SEQ ID NO: 622 - protein, 36 aa, Artificial Sequence
  Core polypeptide
YLEANISQSLEQAQIQQEKNMYELQKLNSWDVFTNW

SEQ ID NO: 623 - protein, 23 aa, Artificial Sequence
  Core polypeptide
YTSLIHSLIEESQNQQEKNEQEL

SEQ ID NO: 624 - protein, 36 aa, Artificial Sequence
  Core polypeptide
YTSLIHSLIEESQNLQEKNEQELLELDKWASLWNWF

SEQ ID NO: 625 - protein, 36 aa, Artificial Sequence
  Core polypeptide
YTSLIHSLIEESQNQQEKLEQELLELDKWASLWNWF

SEQ ID NO: 626 - protein, 36 aa, Artificial Sequence
  Core polypeptide
YTSLIHSLIEESQNQQEKNEQELLEFDKWASLWNWF

SEQ ID NO: 627 - protein, 36 aa, Artificial Sequence
  Core polypeptide
YTSLIHSLIEESQNQQEKNEQELLELDKPASLWNWF

SEQ ID NO: 628 - protein, 36 aa, Artificial Sequence
  Core polypeptide
YTSLIHSLIEESQNQQEKNEQELLELDKWASPWNWF

SEQ ID NO: 629 - protein, 36 aa, Artificial Sequence
  Core polypeptide
YTSLIHSLIEESQNQQEKNEQELLELDKWASLWNSF

SEQ ID NO: 630 - protein, 36 aa, Artificial Sequence; identical to SEQ ID NO: 15
  Core polypeptide

SEQ ID NO: 631 - protein, 36 aa, Artificial Sequence; identical to SEQ ID NO: 15
  Core polypeptide

SEQ ID NO: 632 - protein, 39 aa, Artificial Sequence
  Core polypeptide
FMCYTSLIHSLIEESQNQQEKNEQELLELDKWASLWNWF

SEQ ID NO: 633 - protein, 41 aa, Artificial Sequence
  Core polypeptide
FMCNNLLRAIEAQQHLLQLTVWGIKQLQARILAVERYLKDQ

SEQ ID NO: 634 - protein, 30 aa, Artificial Sequence
  Core polypeptide
EWDREINNYTSLIHSLIEESQNQQEKNEQE

SEQ ID NO: 635 - protein, 29 aa, Artificial Sequence
  Core polypeptide
LIEESQNQQEKNEQELLELDKWASLWNWF

SEQ ID NO: 636 - protein, 35 aa, Artificial Sequence
  Core polypeptide
FWNWLSAWKDLELGGPGSGPGGLELDKWASLWNWF

SEQ ID NO: 637 - protein, 29 aa, Artificial Sequence
  Core polypeptide
LIHSLIEESQNQQEKNEQELLELDKWASL

SEQ ID NO: 638 - protein, 35 aa, Artificial Sequence
  Core polypeptide
TSLIHSLIEESQNQQEKNEQELLELDKWASLWNWF

SEQ ID NO: 639 - protein, 33 aa, Artificial Sequence; identical to SEQ ID NO: 61
  Core polypeptide

SEQ ID NO: 640 - protein, 41 aa, Artificial Sequence
  Core polypeptide
GGGGGYTSLIHSLIEESQNQQEKNEQELLELDKWASLWNWF

SEQ ID NO: 641 - protein, 31 aa, Artificial Sequence
  Core polypeptide
HSLIEESQNQQEKNEQELLELDKWASLWNWF

SEQ ID NO: 642 - protein, 36 aa, Artificial Sequence
  Core polypeptide
YTSLIYSLIEESQNQQEKNEQELLELDKWASLWNWF

SEQ ID NO: 643 - protein, 36 aa, Artificial Sequence
  Core polypeptide
YTSLIHSLIEKSQNQQEKNEQELLELDKWASLWNWF

SEQ ID NO: 644 - protein, 36 aa, Artificial Sequence
  Core polypeptide
YTSLIHSSIEESQNQQEKNEQELLELDKWASLWNWF

SEQ ID NO: 645 - protein, 36 aa, Artificial Sequence
  Core polypeptide
LEANISQLLEQAQIQQEKNMYELQKLNSWDVFTNWL

SEQ ID NO: 646 - protein, 35 aa, Artificial Sequence
  Core polypeptide
SLEECDSELEIKRYKNRVASRKCRAKFKQLLQHYR

SEQ ID NO: 647 - protein, 35 aa, Artificial Sequence
  Core polypeptide
LEECDSELEIKRYKNRVASRKCRAKFKQLLQHYRE

SEQ ID NO: 648 - protein, 35 aa, Artificial Sequence
  Core polypeptide
EECDSELEIKRYKNRVASRKCRAKFKQLLQHYREV

SEQ ID NO: 649 - protein, 35 aa, Artificial Sequence
  Core polypeptide
ECDSELEIKRYKNRVASRKCRAKFKQLLQHYREVA

SEQ ID NO: 650 - protein, 35 aa, Artificial Sequence
  Core polypeptide
CDSELEIKRYKNRVASRKCRAKFKQLLQHYREVAA

SEQ ID NO: 651 - protein, 35 aa, Artificial Sequence
  Core polypeptide
DSELEIKRYKNRVASRKCRAKFKQLLQHYREVAAA

SEQ ID NO: 652 - protein, 49 aa, Artificial Sequence
  Core polypeptide
DESAMINTYRSINEFDASISQVNEKINQSLAFIRKSDELLHNVNAGKST

SEQ ID NO: 653 - protein, 7 aa, Artificial Sequence
  Core polypeptide
WASLWNW

SEQ ID NO: 654 - protein, 38 aa, Artificial Sequence
  Core polypeptide
EAQQHLLQLTVWGIKQLQARILAVERYLKDQQLLGIWG

SEQ ID NO: 655 - protein, 38 aa, Artificial Sequence
  Core polypeptide
IEAQQHLLQLTVWGIKQLQARILAVERYLKDQQLLGIW

SEQ ID NO: 656 - protein, 38 aa, Artificial Sequence
  Core polypeptide
AIEAQQHLLQLTVWGIKQLQARILAVERYLKDQQLLGI

SEQ ID NO: 657 - protein, 38 aa, Artificial Sequence
  Core polypeptide
RAIEAQQHLLQLTVWGIKQLQARILAVERYLKDQQLLG

SEQ ID NO: 658 - protein, 38 aa, Artificial Sequence
  Core polypeptide
LRAIEAQQHLLQLTVWGIKQLQARILAVERYLKDQQLL

SEQ ID NO: 659 - protein, 38 aa, Artificial Sequence
  Core polypeptide
LLRAIEAQQHLLQLTVWGIKQLQARILAVERYLKDQQL

SEQ ID NO: 660 - protein, 38 aa, Artificial Sequence
  Core polypeptide
NLLRAIEAQQHLLQLTVWGIKQLQARILAVERYLKDQQ

SEQ ID NO: 661 - protein, 38 aa, Artificial Sequence
  Core polypeptide
QNNLLRAIEAQQHLLQLTVWGIKQLQARILAVERYLKD

SEQ ID NO: 662 - protein, 38 aa, Artificial Sequence
  Core polypeptide
QQNNLLRAIEAQQHLLQLTVWGIKQLQARILAVERYLK

SEQ ID NO: 663 - protein, 38 aa, Artificial Sequence
  Core polypeptide
QQQNNLLRAIEAQQHLLQLTVWGIKQLQARILAVERYL

SEQ ID NO: 664 - protein, 38 aa, Artificial Sequence
  Core polypeptide
VQQQNNLLRAIEAQQHLLQLTVWGIKQLQARILAVERY

SEQ ID NO: 665 - protein, 38 aa, Artificial Sequence
  Core polypeptide
IVQQQNNLLRAIEAQQHLLQLTVWGIKQLQARILAVER

SEQ ID NO: 666 - protein, 38 aa, Artificial Sequence
  Core polypeptide
GIVQQQNNLLRAIEAQQHLLQLTVWGIKQLQARILAVE

SEQ ID NO: 667 - protein, 38 aa, Artificial Sequence
  Core polypeptide
SGIVQQQNNLLRAIEAQQHLLQLTVWGIKQLQARILAV

SEQ ID NO: 668 - protein, 38 aa, Artificial Sequence
  Core polypeptide
RSMTLTVQARQLLSGIVQQQNNLLRAIEAQQHLLQLTV

SEQ ID NO: 669 - protein, 38 aa, Artificial Sequence
  Core polypeptide
GARSMTLTVQARQLLSGIVQQQNNLLRAIEAQQHLLQL

SEQ ID NO: 670 - protein, 38 aa, Artificial Sequence
  Core polypeptide
GSTMGARSMTLTVQARQLLSGIVQQQNNLLRAIEAQQH

SEQ ID NO: 671 - protein, 38 aa, Artificial Sequence; identical to SEQ ID NO: 670
  Core polypeptide

SEQ ID NO: 672 - protein, 38 aa, Artificial Sequence
  Core polypeptide
EGSTMGARSMTLTVQARQLLSGIVQQQNNLLRAIEAQQ

SEQ ID NO: 673 - protein, 28 aa, Artificial Sequence
  Core polypeptide
RAKFKQLLQHYREVAAAKSSENDRLRLL

SEQ ID NO: 674 - protein, 28 aa, Artificial Sequence
  Core polypeptide
AKFKQLLQHYREVAAAKSSENDRLRLLL

SEQ ID NO: 675 - protein, 28 aa, Artificial Sequence
  Core polypeptide
KFKQLLQHYREVAAAKSSENDRLRLLLK

SEQ ID NO: 676 - protein, 28 aa, Artificial Sequence
  Core polypeptide
FKQLLQHYREVAAAKSSENDRLRLLLKQ

SEQ ID NO: 677 - protein, 35 aa, Artificial Sequence
  Core polypeptide
RAKFKQELQHYREVAAAKSSENDRLRLLLKQMCPS

SEQ ID NO: 678 - protein, 10 aa, Artificial Sequence
  Core polypeptide
DKWASLWNWF

SEQ ID NO: 679 - protein, 35 aa, Artificial Sequence; identical to SEQ ID NO: 114
  Core polypeptide

SEQ ID NO: 680 - protein, 35 aa, Artificial Sequence
  Core polypeptide
YDASISQVNEKINQSLAFIRKSDELLHNVNAGKST

SEQ ID NO: 681 - protein, 35 aa, Artificial Sequence
  Core polypeptide
YDASISQVNEKINQSLAYIRKSDELLHNVNAGKST

SEQ ID NO: 682 - protein, 35 aa, Artificial Sequence
  Core polypeptide
FDASISQVNEKINQSLAYIRKSDELLHNVNAGKST

SEQ ID NO: 683 - protein, 35 aa, Artificial Sequence
  Core polypeptide
FDASISQVQEKIQQSLAFIRKSDELLHQVQAGKST

SEQ ID NO: 684 - protein, 35 aa, Artificial Sequence
  Core polypeptide
FDASISQVNEKINQALAFIRKADELLHNVNAGKST

SEQ ID NO: 685 - protein, 35 aa, Artificial Sequence
  Core polypeptide
FDASISQVNEKINQALAFIRKSDELLHNVNAGKST

SEQ ID NO: 686 - protein, 35 aa, Artificial Sequence
  Core polypeptide
FDASISQVNEKINQSLAFIRKADELLHNVNAGKST

SEQ ID NO: 687 - protein, 35 aa, Artificial Sequence
  Core polypeptide
YDASISQVQEEIQQALAFIRKADELLEQVQAGKST

SEQ ID NO: 688 - protein, 35 aa, Artificial Sequence
  Core polypeptide
FDASISQVNEKINQSLAFIRKSDELLENVNAGKST

SEQ ID NO: 689 - protein, 35 aa, Artificial Sequence
  Core polypeptide
FDASISQVNEEINQSLAFIRKSDELLHNVNAGKST

SEQ ID NO: 690 - protein, 35 aa, Artificial Sequence
  Core polypeptide
VFPSDEFDASISQVNEKINQSLAFIRKSDELLENV

SEQ ID NO: 691 - protein, 35 aa, Artificial Sequence
  Core polypeptide
VFPSDEFDASISQVNEEINQSLAFIRKSDELLENV

SEQ ID NO: 692 - protein, 35 aa, Artificial Sequence
  Core polypeptide
VYPSDEYDASISQVNEEINQALAYIRKADELLENV

SEQ ID NO: 693 - protein, 35 aa, Artificial Sequence
  Core polypeptide
VFPSDEFDASISQVNEEINQSLAFIRKSDELLHNV

SEQ ID NO: 694 - protein, 36 aa, Artificial Sequence
  Core polypeptide
SNKSLEQIWNNMTWMEWDREINNYTSLIHSLIEESQ

SEQ ID NO: 695 - protein, 36 aa, Artificial Sequence
  Core polypeptide
WSNKSLEQIWNNMTWMEWDREINNYTSLIHSLIEES

SEQ ID NO: 696 - protein, 36 aa, Artificial Sequence
  Core polypeptide
SWSNKSLEQIWNNMTWMEWDREINNYTSLIHSLIEE

SEQ ID NO: 697 - protein, 36 aa, Artificial Sequence
  Core polypeptide
ASWSNKSLEQIWNNMTWMEWDREINNYTSLIHSLIE

SEQ ID NO: 698 - protein, 36 aa, Artificial Sequence
  Core polypeptide
NASWSNKSLEQIWNNMTWMEWDREINNYTSLIHSLI

SEQ ID NO: 699 - protein, 36 aa, Artificial Sequence
  Core polypeptide
WNASWSNKSLEQIWNNMTWMEWDREINNYTSLIHSL

SEQ ID NO: 700 - protein, 36 aa, Artificial Sequence
  Core polypeptide
PWNASWSNKSLEQIWNNMTWMEWDREINNYTSLIHS

SEQ ID NO: 701 - protein, 36 aa, Artificial Sequence
  Core polypeptide
VPWNASWSNKSLEQIWNNMTWMEWDREINNYTSLIH

SEQ ID NO: 702 - protein, 36 aa, Artificial Sequence
  Core polypeptide
AVPWNASWSNKSLEQIWNNMTWMEWDREINNYTSLI

SEQ ID NO: 703 - protein, 36 aa, Artificial Sequence
  Core polypeptide
TAVPWNASWSNKSLEQIWNNMTWMEWDREINNYTSL

SEQ ID NO: 704 - protein, 36 aa, Artificial Sequence
  Core polypeptide
TTAVPWNASWSNKSLEQIWNNMTWMEWDREINNYTS

SEQ ID NO: 705 - protein, 36 aa, Artificial Sequence; identical to SEQ ID NO: 15
  Core polypeptide

SEQ ID NO: 706 - protein, 35 aa, Artificial Sequence
  Core polypeptide
AAASDEFDASISQVNEKINQSLAFIRKSDELLHNV

SEQ ID NO: 707 - protein, 35 aa, Artificial Sequence
  Core polypeptide
VFPAAAFDASISQVNEKINQSLAFIRKSDELLHNV

SEQ ID NO: 708 - protein, 35 aa, Artificial Sequence
  Core polypeptide
VFPSDEAAASISQVNEKINQSLAFIRKSDELLHNV

SEQ ID NO: 709 - protein, 35 aa, Artificial Sequence
  Core polypeptide
VFPSDEFDAAAAQVNEKINQSLAFIRKSDELLHNV

SEQ ID NO: 710 - protein, 35 aa, Artificial Sequence
  Core polypeptide
VFPSDEFDASISAAAEKINQSLAFIRKSDELLHNV

SEQ ID NO: 711 - protein, 35 aa, Artificial Sequence
  Core polypeptide
VFPSDEFDASISQVNAAANQSLAFIRKSDELLHNV

SEQ ID NO: 712 - protein, 35 aa, Artificial Sequence
  Core polypeptide
VFPSDEFDASISQVNEKIAAALAFIRKSDELLHNV

SEQ ID NO: 713 - protein, 35 aa, Artificial Sequence
  Core polypeptide
VFPSDEFDASISQVNEKINQSAAAIRKSDELLHNV

SEQ ID NO: 714 - protein, 35 aa, Artificial Sequence
  Core polypeptide
VFPSDEFDASISQVNEKINQSLAFAAASDELLHNV

SEQ ID NO: 715 - protein, 35 aa, Artificial Sequence
  Core polypeptide
VFPSDEFDASISQVNEKINQSLAFIRKAAALLHNV

SEQ ID NO: 716 - protein, 35 aa, Artificial Sequence
  Core polypeptide
VFPSDEFDASISQVNEKINQSLAFIRKSDEAAANV

SEQ ID NO: 717 - protein, 35 aa, Artificial Sequence
  Core polypeptide
VFPSDEFDASISQVNEKINQSLAFIRKSDELLAAA

SEQ ID NO: 718 - protein, 35 aa, Artificial Sequence
  Core polypeptide
VYPSDEFDASISQVNEKINQSLAFIRKSDELLHNV

SEQ ID NO: 719 - protein, 36 aa, Artificial Sequence
  Core polypeptide
AAAAIHSLIEESQNQQEKNEQELLELDKWASLWNWF

SEQ ID NO: 720 - protein, 36 aa, Artificial Sequence
  Core polypeptide
YTSLIHSLIEESQQQQEKNEQELLELDKWASLWNWF

SEQ ID NO: 721 - protein, 36 aa, Artificial Sequence
  Core polypeptide
YTSLIHSLIEESQNQQEKQEQELLELDKWASLWNWF

SEQ ID NO: 722 - protein, 36 aa, Artificial Sequence
  Core polypeptide
QIWNNMTWMEWDREINNYTSLIHSLIEESQNQQEKQ

SEQ ID NO: 723 - protein, 36 aa, Artificial Sequence
  Core polypeptide
QIWNNMTWMEWDREINNYTSLIHSLIEESQQQQEKN

SEQ ID NO: 724 - protein, 36 aa, Artificial Sequence
  Core polypeptide
QIWNNMTWMEWDREINNYTSLIHSLIEESQQQQEKQ

SEQ ID NO: 725 - protein, 36 aa, Artificial Sequence
  Core polypeptide
NKSLEQIWNNMTWMEWDREINNYTSLIHSLIEESQQ

SEQ ID NO: 726 - protein, 35 aa, Artificial Sequence
  Core polypeptide
FDASISQVNEKINQSLAFIEESDELLHNVNAGKST

SEQ ID NO: 727 - protein, 9 aa, Artificial Sequence
  Core polypeptide
IRKSDELCL

SEQ ID NO: 728 - protein, 36 aa, Artificial Sequence
  Core polypeptide
YTSLIHSLIEESQNQQEKDEQELLELDKWASLWNWF

SEQ ID NO: 729 - protein, 36 aa, Artificial Sequence
  Core polypeptide
YTSLIHSLIEESQDQQEKNEQELLELDKWASLWNWF

SEQ ID NO: 730 - protein, 36 aa, Artificial Sequence
  Core polypeptide
YTSLIHSLIEESQDQQEKDEQELLELDKWASLWNWF

SEQ ID NO: 731 - protein, 36 aa, Artificial Sequence
  Core polypeptide
YTSLIHSLIEESQNQQEKNEQELLELDKWASLWDWF

SEQ ID NO: 732 - protein, 36 aa, Artificial Sequence
  Core polypeptide
LEANITQSLEQAQIQQEKNMYELQKLNSWDVFTNWL

SEQ ID NO: 733 - protein, 36 aa, Artificial Sequence
  Core polypeptide
LEANISASLEQAQIQQEKNMYELQKLNSWDVFTNWL

SEQ ID NO: 734 - protein, 36 aa, Artificial Sequence
  Core polypeptide
LEANISALLEQAQIQQEKNMYELQKLNSWDVFTNWL

SEQ ID NO: 735 - protein, 36 aa, Artificial Sequence
  Core polypeptide
LEANITALLEQAQIQQEKNMYELQKLNSWDVFTNWL

SEQ ID NO: 736 - protein, 36 aa, Artificial Sequence
  Core polypeptide
LEANITASLEQAQIQQEKNMYELQKLNSWDVFTNWL

SEQ ID NO: 737 - protein, 34 aa, Artificial Sequence
  Core polypeptide
RAKFKQLLQHYREVAAAKSSENDRLRLLLKQMPS

SEQ ID NO: 738 - protein, 30 aa, Artificial Sequence
  Core polypeptide
MNSVKNGTYDYPKYEEESKLNRNEIKGVKL

SEQ ID NO: 739 - protein, 36 aa, Artificial Sequence
  Core polypeptide
WQEWEQKVRYLEANISQSLEQAQIQQEKNMYELQKL

SEQ ID NO: 740 - protein, 35 aa, Artificial Sequence
  Core polypeptide
DEYDASISQVNEKINQSLAFIRKSDELLHNVNAGK

SEQ ID NO: 741 - protein, 34 aa, Artificial Sequence
  Core polypeptide
YTSLIHSLIEESQNQQEKNEQELLELDKWASLWN

SEQ ID NO: 742 - protein, 33 aa, Artificial Sequence
  Core polypeptide
YTSLIHSLIEESQNQQEKNEQELLELDKWASLW

SEQ ID NO: 743 - protein, 32 aa, Artificial Sequence
  Core polypeptide
YTSLIHSLIEESQNQQEKNEQELLELDKWASL

SEQ ID NO: 744 - protein, 31 aa, Artificial Sequence
  Core polypeptide
YTSLIHSLIEESQNQQEKNEQELLELDKWAS

SEQ ID NO: 745 - protein, 51 aa, Artificial Sequence
  Core polypeptide
QARQLLSGIVQQQNNLLRAIEAQQHLLQLTVWGIKQLQARILAVERYLKDQ

SEQ ID NO: 746 - protein, 42 aa, Artificial Sequence
  Core polypeptide
DREINNYTSLIHSLIEESQNQQEKNEQELLELDKWASLWNWF

SEQ ID NO: 747 - protein, 42 aa, Artificial Sequence
  Core polypeptide
NNMTWMEWDREINNYTSLIHSLIEESQNQQEKNEQELLELDK

SEQ ID NO: 748 - protein, 36 aa, Artificial Sequence
  Core polypeptide
YTSLIHSLIEESQNQQEKNEQELLELDKWASLWAAA

SEQ ID NO: 749 - protein, 36 aa, Artificial Sequence
  Core polypeptide
YTSLIHSLIEESQNQQEKNEQELLELDKWAAAANWF

SEQ ID NO: 750 - protein, 36 aa, Artificial Sequence
  Core polypeptide
YTSLIHSLIEESQNQQEKNEQELLELDAAASLWNWF

SEQ ID NO: 751 - protein, 36 aa, Artificial Sequence
  Core polypeptide
YTSLIHSLIEESQNQQEKNEQELLAAAKWASLWNWF

SEQ ID NO: 752 - protein, 36 aa, Artificial Sequence
  Core polypeptide
YTSLIHSLIEESQNQQEKNEQAAAELDKWASLWNWF

SEQ ID NO: 753 - protein, 36 aa, Artificial Sequence
  Core polypeptide
YTSLIHSLIEESQNQQEKAAAELLELDKWASLWNWF

SEQ ID NO: 754 - protein, 36 aa, Artificial Sequence
  Core polypeptide
YTSLIHSLIEESQNQAAANEQELLELDKWASLWNWF

SEQ ID NO: 755 - protein, 36 aa, Artificial Sequence
  Core polypeptide
YTSLIHSLIEESAAAQEKNEQELLELDKWASLWNWF

SEQ ID NO: 756 - protein, 36 aa, Artificial Sequence
  Core polypeptide
YTSLIHSLIAAAQNQQEKNEQELLELDKWASLWNWF

SEQ ID NO: 757 - protein, 36 aa, Artificial Sequence
  Core polypeptide
YTSLIHAAAEESQNQQEKNEQELLELDKWASLWNWF

SEQ ID NO: 758 - protein, 36 aa, Artificial Sequence
  Core polypeptide
YTSAAASLIEESQNQQEKNEQELLELDKWASLWNWF

SEQ ID NO: 759 - protein, 35 aa, Artificial Sequence
  Core polypeptide
EIWNNMTWMEWDRENEKINQSLAFIRKSDELLHNV

SEQ ID NO: 760 - protein, 36 aa, Artificial Sequence
  Core polypeptide
YISEVNEEINQSLAFIRKADELLENVDKWASLWNWF

SEQ ID NO: 761 - protein, 35 aa, Artificial Sequence
  Core polypeptide
TSVITIELSNIKENKANGTDAKVKLIKQELDKYKN

SEQ ID NO: 762 - protein, 38 aa, Artificial Sequence
  Core polypeptide
YTSLIHSLIEESQNQQEKNEQELLELDKWASLWNWFMG

SEQ ID NO: 763 - protein, 21 aa, Artificial Sequence
  Core polypeptide
NEKINQSLAFIRKSDELLHNV

SEQ ID NO: 764 - protein, 35 aa, Artificial Sequence; identical to SEQ ID NO: 104
  Core polypeptide

SEQ ID NO: 765 - protein, 35 aa, Artificial Sequence; identical to SEQ ID NO: 106
  Core polypeptide

SEQ ID NO: 766 - protein, 35 aa, Artificial Sequence; identical to SEQ ID NO: 108
  Core polypeptide

SEQ ID NO: 767 - protein, 35 aa, Artificial Sequence; identical to SEQ ID NO: 112
  Core polypeptide

SEQ ID NO: 768 - protein, 35 aa, Artificial Sequence; identical to SEQ ID NO: 718
  Core polypeptide

SEQ ID NO: 769 - protein, 35 aa, Artificial Sequence; identical to SEQ ID NO: 692
  Core polypeptide

SEQ ID NO: 770 - protein, 35 aa, Artificial Sequence
  Core polypeptide
VYPSDEFDASISQVQEEIQQALAFIRKADELLEQV

SEQ ID NO: 771 - protein, 37 aa, Artificial Sequence
  Core polypeptide
NYTSLIHSLIEESQNQQEKNEQELLELDKWASLWNWF

SEQ ID NO: 772 - protein, 38 aa, Artificial Sequence
  Core polypeptide
NNYTSLIHSLIEESQNQQEKNEQELLELDKWASLWNWF

SEQ ID NO: 773 - protein, 39 aa, Artificial Sequence
  Core polypeptide
INNYTSLIHSLIEESQNQQEKNEQELLELDKWASLWNWF

SEQ ID NO: 774 - protein, 40 aa, Artificial Sequence
  Core polypeptide
EINNYTSLIHSLIEESQNQQEKNEQELLELDKWASLWNWF

SEQ ID NO: 775 - protein, 37 aa, Artificial Sequence
  Core polypeptide
YTSLIHSLIEESQNQQEKNEQELLELDKWASLWNWFN

SEQ ID NO: 776 - protein, 38 aa, Artificial Sequence
  Core polypeptide
YTSLIHSLIEESQNQQEKNEQELLELDKWASLWNWFNI

SEQ ID NO: 777 - protein, 39 aa, Artificial Sequence
  Core polypeptide
YTSLIHSLIEESQNQQEKNEQELLELDKWASLWNWFNIT

SEQ ID NO: 778 - protein, 40 aa, Artificial Sequence
  Core polypeptide
YTSLIHSLIEESQNQQEKNEQELLELDKWASLWNWFNITN

SEQ ID NO: 779 - protein, 43 aa, Artificial Sequence
  Core polypeptide
YDPLVFPSDEFDASISQVNEKINQSLAFIRKSDELLHNVNAGK

SEQ ID NO: 780 - protein, 38 aa, Artificial Sequence
  Core polypeptide
NYTSLIHSLIEESQNQQEKNEQELLELDKWASLWNWFN

SEQ ID NO: 781 - protein, 40 aa, Artificial Sequence
  Core polypeptide
NNYTSLIHSLIEESQNQQEKNEQELLELDKWASLWNWFNI

SEQ ID NO: 782 - protein, 49 aa, Artificial Sequence
  Core polypeptide
KCRAKFKQLLQHYREVAAAKSSENDRLRLLLKQMCPSLDVDSIIPRTPD

SEQ ID NO: 783 - protein, 47 aa, Artificial Sequence
  Core polypeptide
RAKFKQLLQHYREVAAAKSSENDRLRLLLKQMCPSLDVDSIIPRTPD

SEQ ID NO: 784 - protein, 35 aa, Artificial Sequence
  Core polypeptide
VYPSDEYDASISQVNEEINQALAYIAAADELLENV

SEQ ID NO: 785 - protein, 26 aa, Artificial Sequence
  Core polypeptide
YDASISQVNEEINQALAYIRKADELL

SEQ ID NO: 786 - protein, 40 aa, Artificial Sequence
  Core polypeptide
MNLEWMEWDREINNYTSLIHSLIEESQNQQEKNEQELLEL

SEQ ID NO: 787 - protein, 34 aa, Artificial Sequence
  Core polypeptide
KNGTYDYPKYEEESKLNRNEIKGVKLSSMGVYQI

SEQ ID NO: 788 - protein, 35 aa, Artificial Sequence
  Core polypeptide
VTEKIQMASDNINDLIQSGVNTRLLTIQSHVQNYI

SEQ ID NO: 789 - protein, 24 aa, Artificial Sequence
  Core polypeptide
QNQQEKNEQELLELDKWASLWNWF

SEQ ID NO: 790 - protein, 24 aa, Artificial Sequence
  Core polypeptide
QNQQEKNEQELLELDKWASLWNWF

SEQ ID NO: 791 - protein, 5 aa, Artificial Sequence
  Core polypeptide
LWNWF

SEQ ID NO: 792 - protein, 15 aa, Artificial Sequence
  Core polypeptide
ELLELDKWASLWNWF

SEQ ID NO: 793 - protein, 20 aa, Artificial Sequence
  Core polypeptide
EKNEQELLELDKWASLWNWF

SEQ ID NO: 794 - protein, 30 aa, Artificial Sequence
  Core polypeptide
SLIEESQNQQEKNEQELLELDKWASLWNWF

SEQ ID NO: 795 - protein, 35 aa, Artificial Sequence
  Core polypeptide
YTSLIHSLIEESQNQQEKNEQELLELDKWASLWNW

SEQ ID NO: 796 - protein, 34 aa, Artificial Sequence; identical to SEQ ID NO: 741
  Core polypeptide

SEQ ID NO: 797 - protein, 33 aa, Artificial Sequence; identical to SEQ ID NO: 742
  Core polypeptide

SEQ ID NO: 798 - protein, 32 aa, Artificial Sequence; identical to SEQ ID NO: 743
  Core polypeptide

SEQ ID NO: 799 - protein, 35 aa, Artificial Sequence; identical to SEQ ID NO: 638
  Core polypeptide

SEQ ID NO: 800 - protein, 34 aa, Artificial Sequence
  Core polypeptide
SLIHSLIEESQNQQEKNEQELLELDKWASLWNWF

SEQ ID NO: 801 - protein, 33 aa, Artificial Sequence; identical to SEQ ID NO: 61
  Core polypeptide

SEQ ID NO: 802 - protein, 32 aa, Artificial Sequence
  Core polypeptide
IHSLIEESQNQQEKNEQELLELDKWASLWNWF

SEQ ID NO: 803 - protein, 51 aa, Artificial Sequence
  Core polypeptide
AAVALLPAVLLALLAPSELEIKRYKNRVASRKCRAKFKQLLQHYREVAAAK

SEQ ID NO: 804 - protein, 51 aa, Artificial Sequence
  Core polypeptide
AAVALLPAVLLALLAPCRAKFKQLLQHYREVAAAKSSENDRLRLLLKQMCP

SEQ ID NO: 805 - protein, 36 aa, Artificial Sequence
  Core polypeptide
YTSLIHSLIEESQNQQEKNNNIERDWEMWTMNNWIQ

SEQ ID NO: 806 - protein, 35 aa, Artificial Sequence; identical to SEQ ID NO: 692
  Core polypeptide

SEQ ID NO: 807 - protein, 35 aa, Artificial Sequence
  Core polypeptide
LMQLARQLMQLARQMKQLADSLMQLARQVSRLESA

SEQ ID NO: 808 - protein, 34 aa, Artificial Sequence
  Core polypeptide
WMEWDREINNYTSLIHSLIEESQNQQEKNEQELL

SEQ ID NO: 809 - protein, 35 aa, Artificial Sequence
  Core polypeptide
MEWDREINNYTSLIHSLIEESQNQQEKNEQELLEL

SEQ ID NO: 810 - protein, 34 aa, Artificial Sequence
  Core polypeptide
EWDREINNYTSLIHSLIEESQNQQEKNEQELLEL

SEQ ID NO: 811 - protein, 34 aa, Artificial Sequence
  Core polypeptide
MEWDREINNYTSLIHSLIEESQNQQEKNEQELLE

SEQ ID NO: 812 - protein, 36 aa, Artificial Sequence
  Core polypeptide
WNEWDREINNYTSLIHSLIEESQNQQEKNEQELLEL

SEQ ID NO: 813 - protein, 36 aa, Artificial Sequence
  Core polypeptide
YLEYDREINNYTSLIHSLIEESQNQQEKNEQELLEL

SEQ ID NO: 814 - protein, 17 aa, Artificial Sequence
  Core polypeptide
IKQFINMWQEVGKAMYA

SEQ ID NO: 815 - protein, 8 aa, Artificial Sequence
  Core polypeptide
IRKSDELL

SEQ ID NO: 816 - protein, 8 aa, Artificial Sequence
  Core polypeptide
YDASISQV

SEQ ID NO: 817 - protein, 8 aa, Artificial Sequence
  Core polypeptide
NEKINQSL

SEQ ID NO: 818 - protein, 23 aa, Artificial Sequence
  Core polypeptide
SISQVNEEINQALAYIRKADELL

SEQ ID NO: 819 - protein, 20 aa, Artificial Sequence
  Core polypeptide
QVNEEINQALAYIRKADELL

SEQ ID NO: 820 - protein, 17 aa, Artificial Sequence
  Core polypeptide
EEINQALAYIRKADELL

SEQ ID NO: 821 - protein, 14 aa, Artificial Sequence
  Core polypeptide
NQALAYIRKADELL

SEQ ID NO: 822 - protein, 11 aa, Artificial Sequence
  Core polypeptide
LAYIRKADELL

SEQ ID NO: 823 - protein, 26 aa, Artificial Sequence
  Core polypeptide
FDASISQVNEKINQALAFIRKSDELL

SEQ ID NO: 824 - protein, 36 aa, Artificial Sequence; identical to SEQ ID NO: 812
  Core polypeptide

SEQ ID NO: 825 - protein, 45 aa, Artificial Sequence
  Core polypeptide
ASRKCRAKFKQLLQHYREVAAAKSSENDRLRLLLKQMCPSLDVDS

SEQ ID NO: 826 - protein, 4 aa, Artificial Sequence
  Core polypeptide
ZFFG

SEQ ID NO: 827 - protein, 36 aa, Artificial Sequence
  Core polypeptide
WLEWDREINNYTSLIHSLIEESQNQQEKNEQELLEL

SEQ ID NO: 828 - protein, 36 aa, Artificial Sequence
  Core polypeptide
YVKGEPIINFYDPLVFPSDEFDASISQVNEKINQSL

SEQ ID NO: 829 - protein, 35 aa, Artificial Sequence
  Core polypeptide
VYPSDEYDASISQVNEEINQSLAYIRKADELLHNV

SEQ ID NO: 830 - protein, 29 aa, Artificial Sequence
  Core polypeptide
YDASISQVNEEINQALAYIRKADELLENV

SEQ ID NO: 831 - protein, 27 aa, Artificial Sequence
  Core polypeptide
YDASISQVNEEINQALAYIRKADELLE

SEQ ID NO: 832 - protein, 35 aa, Artificial Sequence
  Core polypeptide
VYPSDEYDASISQVNEEINQALAYIRKAAELLHNV

SEQ ID NO: 833 - protein, 35 aa, Artificial Sequence
  Core polypeptide
VYPSDEYDASISQVNEEINQALAYIRKALELLHNV

SEQ ID NO: 834 - protein, 36 aa, Artificial Sequence; identical to SEQ ID NO: 15
  Core polypeptide

SEQ ID NO: 835 - protein, 35 aa, Artificial Sequence
  Core polypeptide
VYPSDEYDASISQVNEEINQLLAYIRKLDELLENV

SEQ ID NO: 836 - protein, 28 aa, Artificial Sequence
  Core polypeptide
DEYDASISQVNEKINQSLAFIRKSDELL

SEQ ID NO: 837 - protein, 35 aa, Artificial Sequence
  Core polypeptide
SNDQGSGYAADKESTQKAFDGITNKVNSVIEKTNT

SEQ ID NO: 838 - protein, 38 aa, Artificial Sequence
  Core polypeptide
ESTQKAFDGITNKVNSVIEKTNTQFEAVGKEFGNLEKR

SEQ ID NO: 839 - protein, 37 aa, Artificial Sequence
  Core polypeptide
DGITNKVNSVIEKTNTQFEAVGKEFGNLEKRLENLNK

SEQ ID NO: 840 - protein, 32 aa, Artificial Sequence
  Core polypeptide
DSNVKNLYDKVRSQLRDNVKELGNGAFEFYHK

SEQ ID NO: 841 - protein, 36 aa, Artificial Sequence
  Core polypeptide
RDNVKELGNGAFEFYHKADDEALNSVKNGTYDYPKY

SEQ ID NO: 842 - protein, 24 aa, Artificial Sequence
  Core polypeptide
EFYHKADDEALNSVKNGTYDYPKY

SEQ ID NO: 843 - protein, 36 aa, Artificial Sequence
  Core polypeptide
AAVALLPAVLLALLAPAADKESTQKAFDGITNKVNS

SEQ ID NO: 844 - protein, 36 aa, Artificial Sequence
  Core polypeptide
AAVALLPAVLLALLAPAADSNVKNLYDKVRSQLRDN

SEQ ID NO: 845 - protein, 18 aa, Artificial Sequence
  Core polypeptide
KESTQKAFDGITNKVNSV

SEQ ID NO: 846 - protein, 20 aa, Artificial Sequence
  Core polypeptide
IEKTNTQFEAVGKEFGNLER

SEQ ID NO: 847 - protein, 30 aa, Artificial Sequence
  Core polypeptide
RLENLNKRVEDGFLDVWTYNAELLVALENE

SEQ ID NO: 848 - protein, 17 aa, Artificial Sequence
  Core polypeptide
SNVKNLYDKVRSQLRDN

SEQ ID NO: 849 - protein, 33 aa, Artificial Sequence
  Core polypeptide
WMEWDREINNYTSLIHSLIEESQNQQEKNEQEL

SEQ ID NO: 850 - protein, 32 aa, Artificial Sequence
  Core polypeptide
WMEWDREINNYTSLIHSLIEESQNQQEKNEQE

SEQ ID NO: 851 - protein, 32 aa, Artificial Sequence
  Core polypeptide
MEWDREINNYTSLIHSLIEESQNQQEKNEQEL

SEQ ID NO: 852 - protein, 31 aa, Artificial Sequence
  Core polypeptide
MEWDREINNYTSLIHSLIEESQNQQEKNEQE

SEQ ID NO: 853 - protein, 33 aa, Artificial Sequence
  Core polypeptide
EWDREINNYTSLIHSLIEESQNQQEKNEQELLE

SEQ ID NO: 854 - protein, 32 aa, Artificial Sequence
  Core polypeptide
EWDREINNYTSLIHSLIEESQNQQEKNEQELL

SEQ ID NO: 855 - protein, 31 aa, Artificial Sequence
  Core polypeptide
EWDREINNYTSLIHSLIEESQNQQEKNEQEL

SEQ ID NO: 856 - protein, 36 aa, Artificial Sequence
  Core polypeptide
YTKFIYTLLEESQNQQEKNEQELLELDKWASLWNWF

SEQ ID NO: 857 - protein, 22 aa, Artificial Sequence
  Core polypeptide
YMKQLADSLMQLARQVSRLESA

SEQ ID NO: 858 - protein, 29 aa, Artificial Sequence
  Core polypeptide
YLMQLARQMKQLADSLMQLARQVSRLESA

SEQ ID NO: 859 - protein, 36 aa, Artificial Sequence
  Core polypeptide
YQEWERKVDFLEENITALLEEAQIQQEKNMYELQKL

SEQ ID NO: 860 - protein, 36 aa, Artificial Sequence
  Core polypeptide
WMAWAAAINNYTSLIHSLIEESQNQQEKNEQEEEEE

SEQ ID NO: 861 - protein, 36 aa, Artificial Sequence
  Core polypeptide
YASLIAALIEESQNQQEKNEQELLELAKWAALWAWF

SEQ ID NO: 862 - protein, 38 aa, Artificial Sequence
  Core polypeptide
EWDREINNYTSLIHSLIEESQNQQEKNEQEGGCDIMER

SEQ ID NO: 863 - protein, 35 aa, Artificial Sequence
  Core polypeptide
YDISIELNKAKSDLEESKEWIKKSNQKLDSIGNWH

SEQ ID NO: 864 - protein, 35 aa, Artificial Sequence; identical to SEQ ID NO: 548
  Core polypeptide

SEQ ID NO: 865 - protein, 6 aa, Artificial Sequence
  Core polypeptide
YTSLIH

SEQ ID NO: 866 - protein, 7 aa, Artificial Sequence
  Core polypeptide
HSLIEEH

SEQ ID NO: 867 - protein, 8 aa, Artificial Sequence
  Core polypeptide
SQNQQEKH

SEQ ID NO: 868 - protein, 9 aa, Artificial Sequence
  Core polypeptide
NEQELLELH

SEQ ID NO: 869 - protein, 7 aa, Artificial Sequence
  Core polypeptide
DKWASLH

SEQ ID NO: 870 - protein, 5 aa, Artificial Sequence
  Core polypeptide
WNWFH

SEQ ID NO: 871 - protein, 36 aa, Artificial Sequence
  Core polypeptide
AKTLERTWDTLNHLLFISSALYKLNLKSVAQITLSI

SEQ ID NO: 872 - protein, 24 aa, Artificial Sequence
  Core polypeptide
NITLQAKIKQFINMWQEVGKAMYA

SEQ ID NO: 873 - protein, 28 aa, Artificial Sequence
  Core polypeptide
LENERTLDFHDSNVKNLYDKVRLQLRDN

SEQ ID NO: 874 - protein, 35 aa, Artificial Sequence
  Core polypeptide
LENERTLDFHDSNVKNLYDKVRLQLRDNVKELGNG

SEQ ID NO: 875 - protein, 34 aa, Artificial Sequence
  Core polypeptide
TLDFHDSNVKNLYDKVRLQLRDNVKELGNGAFEF

SEQ ID NO: 876 - protein, 26 aa, Artificial Sequence
  Core polypeptide
FDASISQVNEKINQALAFIRKSDELL

SEQ ID NO: 877 - protein, 23 aa, Artificial Sequence
  Core polypeptide
SISQVNEEINQALAYIRKADELL

SEQ ID NO: 878 - protein, 23 aa, Artificial Sequence
  Core polypeptide
SISQVNEEINQSLAYIRKSDELL

SEQ ID NO: 879 - protein, 23 aa, Artificial Sequence
  Core polypeptide
SISQVNEEINQSLAYIRKSDELL

SEQ ID NO: 880 - protein, 35 aa, Artificial Sequence
  Core polypeptide
NSVALDPIDISIELNKAKSDLEESKEWIKKSNQKL

SEQ ID NO: 881 - protein, 35 aa, Artificial Sequence
  Core polypeptide
ALDPIDISIELNKAKSDLEESKEWIKKSNQKLDSI

SEQ ID NO: 882 - protein, 35 aa, Artificial Sequence; identical to SEQ ID NO: 880
  Core polypeptide

SEQ ID NO: 883 - protein, 35 aa, Artificial Sequence; identical to SEQ ID NO: 881
  Core polypeptide

SEQ ID NO: 884 - protein, 26 aa, Artificial Sequence
  Core polypeptide
YDASISQVNEEINQALAYIRKADELL

SEQ ID NO: 885 - protein, 26 aa, Artificial Sequence
  Core polypeptide
YDASISQVNEEINQSLAFIRKSDELL

SEQ ID NO: 886 - protein, 26 aa, Artificial Sequence
  Core polypeptide
YDASISQVNEEINQSLAFIRKSDELL

SEQ ID NO: 887 - protein, 33 aa, Artificial Sequence
  Core polypeptide
WLEWDREINNYTSLIHSLIEESQNQQEKNEQEL

SEQ ID NO: 888 - protein, 35 aa, Artificial Sequence; identical to SEQ ID NO: 202
  Core polypeptide

SEQ ID NO: 889 - protein, 35 aa, Artificial Sequence; identical to SEQ ID NO: 880
  Core polypeptide

SEQ ID NO: 890 - protein, 26 aa, Artificial Sequence
  Core polypeptide
YDASISQVNEEINQALAYIRKADELL

SEQ ID NO: 891 - protein, 28 aa, Artificial Sequence
  Core polypeptide
DEYDASISQVNEKINQSLAFIRKSDELL

SEQ ID NO: 892 - protein, 33 aa, Artificial Sequence
  Core polypeptide
WQEWEQKVRYLEANISQSLEQAQIQQEKNMYEL

SEQ ID NO: 893 - protein, 33 aa, Artificial Sequence
  Core polypeptide
WQEWEQKVRYLEANISQSLEQAQIQQEKNEYEL

SEQ ID NO: 894 - protein, 33 aa, Artificial Sequence
  Core polypeptide
WQEWEQKVRYLEANITALLEQAQIQQEKNEYEL

SEQ ID NO: 895 - protein, 33 aa, Artificial Sequence
  Core polypeptide
WQEWEQKVRYLEANITALLEQAQIQQEKNMYEL

SEQ ID NO: 896 - protein, 36 aa, Artificial Sequence
  Core polypeptide
WQEWEQKVRYLEANISQSLEQAQIQQEKNEYELQKL

SEQ ID NO: 897 - protein, 36 aa, Artificial Sequence
  Core polypeptide
WQEWEQKVRYLEANITALLEQAQIQQEKNEYELQKL

SEQ ID NO: 898 - protein, 36 aa, Artificial Sequence
  Core polypeptide
WQEWEQKVRYLEANITALLEQAQIQQEKNMYELQKL

SEQ ID NO: 899 - protein, 37 aa, Artificial Sequence
  Core polypeptide
EFGNLEKRLENLNKRVEDGFLDVWTYNAELLVALENE

SEQ ID NO: 900 - protein, 42 aa, Artificial Sequence
  Core polypeptide
EDGFLDVWTYNAELLVLMENERTLDFHDSNVKNLYDKVRMQL

SEQ ID NO: 901 - protein, 23 aa, Artificial Sequence
  Core polypeptide
SISQVNEKINQSLAFIRKSDELL

SEQ ID NO: 902 - protein, 23 aa, Artificial Sequence
  Core polypeptide
SISQVNEKINQSLAFIRKSDELL

SEQ ID NO: 903 - protein, 23 aa, Artificial Sequence
  Core polypeptide
SISQVNEKINQSLAYIRKSDELL

SEQ ID NO: 904 - protein, 38 aa, Artificial Sequence
  Core polypeptide
QQLLDVVKRQQEMLRLTVWGTKNLQARVTAIEKYLKDQ

SEQ ID NO: 905 - protein, 37 aa, Artificial Sequence
  Core polypeptide
YTSLIHSLIEESQNQQEKNEQELLELDKWASLWNWFC

SEQ ID NO: 906 - protein, 26 aa, Artificial Sequence
  Core polypeptide
FDASISQVNEKINQSLAYIRKSDELL

SEQ ID NO: 907 - protein, 30 aa, Artificial Sequence
  Core polypeptide
YTSLIHSLIEESQNQQEKNEQELLELDKWA

SEQ ID NO: 908 - protein, 28 aa, Artificial Sequence
  Core polypeptide
DEFDASISQVNEKINQSLAFIRKSDELL

SEQ ID NO: 909 - protein, 28 aa, Artificial Sequence
  Core polypeptide
DEFDESISQVNEKINQSLAFIRKSDELL

SEQ ID NO: 910 - protein, 28 aa, Artificial Sequence
  Core polypeptide
DEFDESISQVNEKIEQSLAFIRKSDELL

SEQ ID NO: 911 - protein, 28 aa, Artificial Sequence
  Core polypeptide
DEFDESISQVNEKIEESLAFIRKSDELL

SEQ ID NO: 912 - protein, 28 aa, Artificial Sequence
  Core polypeptide
DEFDESISQVNEKIEESLQFIRKSDELL

SEQ ID NO: 913 - protein, 33 aa, Artificial Sequence
  Core polypeptide
GGGGGDEFDASISQVNEKINQSLAFIRKSDELL

SEQ ID NO: 914 - protein, 28 aa, Artificial Sequence
  Core polypeptide
DEFDASISQVNEKINQSLAFIRKSDELL

SEQ ID NO: 915 - protein, 28 aa, Artificial Sequence
  Core polypeptide
DEFDASISQVNEKINQSLAFIRKSDELL

SEQ ID NO: 916 - protein, 35 aa, Artificial Sequence; identical to SEQ ID NO: 198
  Core polypeptide

SEQ ID NO: 917 - protein, 35 aa, Artificial Sequence
  Core polypeptide
YDASISQVNEKINQALAYIRKADELLHNVNAGKST

SEQ ID NO: 918 - protein, 35 aa, Artificial Sequence
  Core polypeptide
VYPSDEYDASISQVNEKINQALAYIRKADELLHNV

SEQ ID NO: 919 - protein, 8 aa, Artificial Sequence
  Core polypeptide
WGWGYGYG

SEQ ID NO: 920 - protein, 9 aa, Artificial Sequence
  Core polypeptide
YGWGWGWGF

SEQ ID NO: 921 - protein, 36 aa, Artificial Sequence
  Core polypeptide
WQEWEQKVRYLEANITALQEQAQIQAEKAEYELQKL

SEQ ID NO: 922 - protein, 36 aa, Artificial Sequence
  Core polypeptide
WQEWEQKVRYLEAEITALQEEAQIQAEKAEYELQKL

SEQ ID NO: 923 - protein, 31 aa, Artificial Sequence; identical to SEQ ID NO: 744
  Core polypeptide

SEQ ID NO: 924 - protein, 35 aa, Artificial Sequence
  Core polypeptide
VWPSDEFDASISQVNEKINQSLAFIRKSDELLHNV

SEQ ID NO: 925 - protein, 35 aa, Artificial Sequence
  Core polypeptide
SKNISEQIDQIKKDEQKEGTGWGLGGKWWTSDWGV

SEQ ID NO: 926 - protein, 35 aa, Artificial Sequence
  Core polypeptide
LSKNISEQIDQIKKDEQKEGTGWGLGGKWWTSDWG

SEQ ID NO: 927 - protein, 35 aa, Artificial Sequence
  Core polypeptide
DLSKNISEQIDQIKKDEQKEGTGWGLGGKWWTSDW

SEQ ID NO: 928 - protein, 35 aa, Artificial Sequence
  Core polypeptide
EDLSKNISEQIDQIKKDEQKEGTGWGLGGKWWTSD

SEQ ID NO: 929 - protein, 35 aa, Artificial Sequence
  Core polypeptide
IEDLSKNISEQIDQIKKDEQKEGTGWGLGGKWWTS

SEQ ID NO: 930 - protein, 35 aa, Artificial Sequence
  Core polypeptide
GIEDLSKNISEQIDQIKKDEQKEGTGWGLGGKWWT

SEQ ID NO: 931 - protein, 35 aa, Artificial Sequence
  Core polypeptide
IGIEDLSKNISEQIDQIKKDEQKEGTGWGLGGKWW

SEQ ID NO: 932 - protein, 34 aa, Artificial Sequence
  Core polypeptide
PSDEFDASISQVNEKINQSLAFIRKSDELLHNVN

SEQ ID NO: 933 - protein, 35 aa, Artificial Sequence
  Core polypeptide
VYPSDEYDASISQVNEKINQALAYIRKADELLENV

SEQ ID NO: 934 - protein, 35 aa, Artificial Sequence
  Core polypeptide
VYPSDEFDASISQVNEKINQALAFIRKADELLENV

SEQ ID NO: 935 - protein, 35 aa, Artificial Sequence
  Core polypeptide
VYPSDEYDASISQVNEKINQALAYIREADELLENV

SEQ ID NO: 936 - protein, 26 aa, Artificial Sequence
  Core polypeptide
YDASISQVNEKINQSLAFIRESDELL

SEQ ID NO: 937 - protein, 35 aa, Artificial Sequence
  Core polypeptide
AIGIEDLSKNISEQIDQIKKDEQKEGTGWGLGGKW

SEQ ID NO: 938 - protein, 35 aa, Artificial Sequence
  Core polypeptide
AAIGIEDLSKNISEQIDQIKKDEQKEGTGWGLGGK

SEQ ID NO: 939 - protein, 35 aa, Artificial Sequence
  Core polypeptide
DAAIGIEDLSKNISEQIDQIKKDEQKEGTGWGLGG

SEQ ID NO: 940 - protein, 35 aa, Artificial Sequence
  Core polypeptide
PDAAIGIEDLSKNISEQIDQIKKDEQKEGTGWGLG

SEQ ID NO: 941 - protein, 35 aa, Artificial Sequence
  Core polypeptide
NITDKIDQIIHDFVDKTLPDQGDNDNWWTGWRQWI

SEQ ID NO: 942 - protein, 35 aa, Artificial Sequence
  Core polypeptide
KNITDKIDQIIHDFVDKTLPDQGDNDNWWTGWRQW

SEQ ID NO: 943 - protein, 35 aa, Artificial Sequence
  Core polypeptide
TKNITDKIDQIIHDFVDKTLPDQGDNDNWWTGWRQ

SEQ ID NO: 944 - protein, 35 aa, Artificial Sequence
  Core polypeptide
WTKNITDKIDQIIHDFVDKTLPDQGDNDNWWTGWR

SEQ ID NO: 945 - protein, 35 aa, Artificial Sequence
  Core polypeptide
DWTKNITDKIDQIIHDFVDKTLPDQGDNDNWWTGW

SEQ ID NO: 946 - protein, 35 aa, Artificial Sequence
  Core polypeptide
HDWTKNITDKIDQIIHDFVDKTLPDQGDNDNWWTG

SEQ ID NO: 947 - protein, 35 aa, Artificial Sequence
  Core polypeptide
PHDWTKNITDKIDQIIHDFVDKTLPDQGDNDNWWT

SEQ ID NO: 948 - protein, 35 aa, Artificial Sequence
  Core polypeptide
EPHDWTKNITDKIDQIIHDFVDKTLPDQGDNDNWW

SEQ ID NO: 949 - protein, 35 aa, Artificial Sequence
  Core polypeptide
IEPHDWTKNITDKIDQIIHDFVDKTLPDQGDNDNW

SEQ ID NO: 950 - protein, 35 aa, Artificial Sequence
  Core polypeptide
AIEPHDWTKNITDKIDQIIHDFVDKTLPDQGDNDN

SEQ ID NO: 951 - protein, 35 aa, Artificial Sequence
  Core polypeptide
AAIEPHDWTKNITDKIDQIIHDFVDKTLPDQGDND

SEQ ID NO: 952 - protein, 35 aa, Artificial Sequence
  Core polypeptide
DAAIEPHDWTKNITDKIDQIIHDFVDKTLPDQGDN

SEQ ID NO: 953 - protein, 35 aa, Artificial Sequence
  Core polypeptide
LSPTVWLSVIWMMWYWGPSLYSILSPFLPLLPIFF

SEQ ID NO: 954 - protein, 45 aa, Artificial Sequence
  Core polypeptide
HNHTTWMEWDREINNYTSLIHSLIEESQNQQEKNEQELLELDKWH

SEQ ID NO: 955 - protein, 53 aa, Artificial Sequence
  Core polypeptide
HQARQLLSGIVQQQNNLLRAIEAQQHLLQLTVWGIKQLQARILAVERYLKDQH

SEQ ID NO: 956 - protein, 35 aa, Artificial Sequence
  Core polypeptide
VYPSDEFDASISQVNEKINQSLAFIREADELLENV

SEQ ID NO: 957 - protein, 35 aa, Artificial Sequence
  Core polypeptide
VFPSDEFDASISQVNEKINQSLAYIREADELLENV

SEQ ID NO: 958 - protein, 28 aa, Artificial Sequence
  Core polypeptide
DEFDASISQVNEKINQSLAYIREADELL

SEQ ID NO: 959 - protein, 50 aa, Artificial Sequence
  Core polypeptide
NEQELLELDKWASLWNWFGGGGDEFDASISQVNEKINQSLAFIRKSDELL

SEQ ID NO: 960 - protein, 45 aa, Artificial Sequence
  Core polypeptide
LELDKWASLWNWFGGGGDEFDASISQVNEKINQSLAFIRKSDELL

SEQ ID NO: 961 - protein, 36 aa, Artificial Sequence
  Core polypeptide
EGEGEGEGDEFDASISQVNEKINQSLAFIRKSDELL

SEQ ID NO: 962 - protein, 43 aa, Artificial Sequence
  Core polypeptide
ASRKCRAKFKQLLQHYREVAAAKSSENDRLRLLLKQMCPSLDV

SEQ ID NO: 963 - protein, 29 aa, Artificial Sequence
  Core polypeptide
GDEEDASISQVNEKINQSLAFIRKSDELL

SEQ ID NO: 964 - protein, 29 aa, Artificial Sequence
  Core polypeptide
GDEEDASESQVNEKINQSLAFIRKSDELL

SEQ ID NO: 965 - protein, 29 aa, Artificial Sequence
  Core polypeptide
GDEEDASESQQNEKINQSLAFIRKSDELL

SEQ ID NO: 966 - protein, 29 aa, Artificial Sequence
  Core polypeptide
GDEEDASESQQNEKQNQSLAFIRKSDELL

SEQ ID NO: 967 - protein, 29 aa, Artificial Sequence
  Core polypeptide
GDEEDASESQQNEKQNQSEAFIRKSDELL

SEQ ID NO: 968 - protein, 30 aa, Artificial Sequence
  Core polypeptide
WGDEFDESISQVNEKIEESLAFIRKSDELL

SEQ ID NO: 969 - protein, 40 aa, Artificial Sequence
  Core polypeptide
YTSLGGDEFDESISQVNEKIEESLAFIRKSDELLGGWNWF

SEQ ID NO: 970 - protein, 48 aa, Artificial Sequence
  Core polypeptide
YTSLIHSLGGDEFDESISQVNEKIEESLAFIRKSDELLGGWASLWNWF

SEQ ID NO: 971 - protein, 29 aa, Artificial Sequence
  Core polypeptide
GDEFDESISQVNEKIEESLAFIRKSDELL

SEQ ID NO: 972 - protein, 29 aa, Artificial Sequence
  Core polypeptide
GDEEDESISQVNEKIEESLAFIRKSDELL

SEQ ID NO: 973 - protein, 29 aa, Artificial Sequence
  Core polypeptide
GDEEDESISQVQEKIEESLAFIRKSDELL

SEQ ID NO: 974 - protein, 29 aa, Artificial Sequence
  Core polypeptide
GDEEDESISQVQEKIEESLLFIRKSDELL

SEQ ID NO: 975 - protein, 29 aa, Artificial Sequence
  Core polypeptide
GDEYDESISQVNEKIEESLAFIRKSDELL

SEQ ID NO: 976 - protein, 29 aa, Artificial Sequence
  Core polypeptide
GDEYDESISQVNEKIEESLAFIRKSDELL

SEQ ID NO: 977 - protein, 36 aa, Artificial Sequence
  Core polypeptide
YTSLIHSLIDEQEKIEELAFIRKSDELLELDKWNWF

SEQ ID NO: 978 - protein, 35 aa, Artificial Sequence; identical to SEQ ID NO: 692
  Core polypeptide

SEQ ID NO: 979 - protein, 38 aa, Artificial Sequence
  Core polypeptide
NNLLRAIEAQQHLLQLTVWGSKQLQARILAVERYLKDQ

SEQ ID NO: 980 - protein, 38 aa, Artificial Sequence
  Core polypeptide
GGGVYPSDEYDASISQVNEEINQALAYIRKADELLENV

SEQ ID NO: 981 - protein, 38 aa, Artificial Sequence
  Core polypeptide
NNLLRAIEAQQHLLQLTVWGEKQLQARILAVERYLKDQ

SEQ ID NO: 982 - protein, 28 aa, Artificial Sequence
  Core polypeptide
PTRVNYILIIGVLVLAEVTGVRADVHLL

SEQ ID NO: 983 - protein, 35 aa, Artificial Sequence
  Core polypeptide
PTRVNYILIIGVLVLAEVTGVRADVHLLEQPGNLW

SEQ ID NO: 984 - protein, 36 aa, Artificial Sequence
  Core polypeptide
PEKTPLLPTRVNYILIIGVLVLABEVTGVRADVHLL

SEQ ID NO: 985 - protein, 38 aa, Artificial Sequence; identical to SEQ ID NO: 980
  Core polypeptide

SEQ ID NO: 986 - protein, 38 aa, Artificial Sequence
  Core polypeptide
YTSLIHSLGGDEFDESISQVNEKIEESLAFIRKSDELL

SEQ ID NO: 987 - protein, 34 aa, Artificial Sequence
  Core polypeptide
YTSLGGDEFDESISQVNEKIEESLAFIRKSDELL

SEQ ID NO: 988 - protein, 38 aa, Artificial Sequence
  Core polypeptide
DEFDESISQVNEKIEESLAFIRKSDELLGGWASLWNWF

SEQ ID NO: 989 - protein, 34 aa, Artificial Sequence
  Core polypeptide
DEFDESISQVNEKIEESLAFIRKSDELLGGWNWF

SEQ ID NO: 990 - protein, 35 aa, Artificial Sequence
  Core polypeptide
YTSLIHSLIEESQNQQEKNEQELLELDKASLWNWF

SEQ ID NO: 991 - protein, 34 aa, Artificial Sequence
  Core polypeptide
YTSLIHSLIEESQNQQEKNEQELLELDKSLWNWF

SEQ ID NO: 992 - protein, 33 aa, Artificial Sequence
  Core polypeptide
YTSLIHSLIEESQNQQEKNEQELLELDKLWNWF

SEQ ID NO: 993 - protein, 32 aa, Artificial Sequence
  Core polypeptide
YTSLIHSLIEESQNQQEKNEQELLELDKWNWF

SEQ ID NO: 994 - protein, 47 aa, Artificial Sequence
  Core polypeptide
MTWMEWDREINNYTSLIHSLIEESQNQQEKNEQELLELDKASLWNWF

SEQ ID NO: 995 - protein, 46 aa, Artificial Sequence
  Core polypeptide
MTWMEWDREINNYTSLIHSLIEESQNQQEKNEQELLELDKSLWNWF

SEQ ID NO: 996 - protein, 45 aa, Artificial Sequence
  Core polypeptide
MTWMEWDREINNYTSLIHSLIEESQNQQEKNEQELLELDKLWNWF

SEQ ID NO: 997 - protein, 44 aa, Artificial Sequence
  Core polypeptide
MTWMEWDREINNYTSLIHSLIEESQNQQEKNEQELLELDKWNWF

SEQ ID NO: 998 - protein, 46 aa, Artificial Sequence
  Core polypeptide
MTWMEWDREINNYTSLIHSLIEESQNQQEKNEQELLELDKWASLWN

SEQ ID NO: 999 - protein, 44 aa, Artificial Sequence
  Core polypeptide
MTWMEWDREINNYTSLIHSLIEESQNQQEKNEQELLELDKWASL

SEQ ID NO: 1000 - protein, 8 aa, Artificial Sequence
  Core polypeptide
HWSYLRPG

SEQ ID NO: 1001 - protein, 36 aa, Artificial Sequence
  Core polypeptide
WNWFDEFDESISQVNEKIEESLAFIRKSDELLWNWF

SEQ ID NO: 1002 - protein, 36 aa, Artificial Sequence
  Core polypeptide
YTSLIHSLIEESQNQQEKNEQELLELDKYASLYNYF

SEQ ID NO: 1003 - protein, 36 aa, Artificial Sequence
  Core polypeptide
YTSLIHSLIEESQNQQEKNEQELLELDKYAYLYNYF

SEQ ID NO: 1004 - protein, 29 aa, Artificial Sequence
  Core polypeptide
DEFDESISQVNEKIEESLAFIRKSDELLW

SEQ ID NO: 1005 - protein, 31 aa, Artificial Sequence
  Core polypeptide
GDEFDESISQVNEKIEESLAFIRKSDELLGW

SEQ ID NO: 1006 - protein, 29 aa, Artificial Sequence
  Core polypeptide
GDEFDESISQVNEKIEESLAFIRESDELL

SEQ ID NO: 1007 - protein, 29 aa, Artificial Sequence
  Core polypeptide
GDEFDESISQVNEKIEESLAFIEESDELL

SEQ ID NO: 1008 - protein, 36 aa, Artificial Sequence
  Core polypeptide
WQEWEQKVNYLEANITALLEQAQIQQEKNEYELQKL

SEQ ID NO: 1009 - protein, 36 aa, Artificial Sequence
  Core polypeptide
WQEWEQKVDYLEANITALLEQAQIQQEKNEYELQKL

SEQ ID NO: 1010 - protein, 36 aa, Artificial Sequence
  Core polypeptide
WQEWEQKVRWLEANITALLEQAQIQQEKNEYELQKL

SEQ ID NO: 1011 - protein, 36 aa, Artificial Sequence
  Core polypeptide
WQEWEKQVRYLEANITALLEQAQIQQEKNEYELQKL

SEQ ID NO: 1012 - protein, 36 aa, Artificial Sequence
  Core polypeptide
WQEWEHQVRYLEANITALLEQAQIQQEKNEYELQKL

SEQ ID NO: 1013 - protein, 36 aa, Artificial Sequence
  Core polypeptide
WQEWEHKVRYLEANITALLEQAQIQQEKNEYELQKL

SEQ ID NO: 1014 - protein, 36 aa, Artificial Sequence
  Core polypeptide
WQEWDREVRYLEANITALLEQAQIQQEKNEYELQKL

SEQ ID NO: 1015 - protein, 36 aa, Artificial Sequence
  Core polypeptide
WQEWEREVRYLEANITALLEQAQIQQEKNEYELQKL

SEQ ID NO: 1016 - protein, 36 aa, Artificial Sequence
  Core polypeptide
WQEWERQVRYLEANITALLEQAQIQQEKNEYELQKL

SEQ ID NO: 1017 - protein, 36 aa, Artificial Sequence
  Core polypeptide
WQEWEQKVKYLEANITALLEQAQIQQEKNEYELQKL

SEQ ID NO: 1018 - protein, 36 aa, Artificial Sequence
  Core polypeptide
WQEWEQKVRFLEANITALLEQAQIQQEKNEYELQKL

SEQ ID NO: 1019 - protein, 35 aa, Artificial Sequence
  Core polypeptide
VNPSDEYDASISQVNEEINQALAYIRKADELLENV

SEQ ID NO: 1020 - protein, 35 aa, Artificial Sequence
  Core polypeptide
VNPSDENDASISQVNEEINQALAYIRKADELLENV

SEQ ID NO: 1021 - protein, 35 aa, Artificial Sequence
  Core polypeptide
VNPSDEYDASISQVNEEINQALANIRKADELLENV

SEQ ID NO: 1022 - protein, 36 aa, Artificial Sequence
  Core polypeptide
VYPSDEFDASISQVNEKINQSLAFIREADELLFNFF

SEQ ID NO: 1023 - protein, 36 aa, Artificial Sequence
  Core polypeptide
VYPSDEYDASISQVNEEINQALAYIRKADELLFNFF

SEQ ID NO: 1024 - protein, 36 aa, Artificial Sequence
  Core polypeptide
YTSLITALLEQAQIQQEKNEYELQKLDKWASLWNWF

SEQ ID NO: 1025 - protein, 36 aa, Artificial Sequence
  Core polypeptide
YTSLITALLEQAQIQQEKNEYELQKLDKWASLWEWF

SEQ ID NO: 1026 - protein, 36 aa, Artificial Sequence
  Core polypeptide
YTSLITALLEQAQIQQEKNEYELQKLDEWASLWEWF

SEQ ID NO: 1027 - protein, 36 aa, Artificial Sequence
  Core polypeptide
YTSLITALLEQAQIQQEKNEYELQELDEWASLWEWF

SEQ ID NO: 1028 - protein, 36 aa, Artificial Sequence
  Core polypeptide
YTSLITALLEEAQIQQEKNEYELQELDEWASLWEWF

SEQ ID NO: 1029 - protein, 28 aa, Artificial Sequence
  Core polypeptide
AAATALLEQAQIQQEKNEYELQKLAAAW

SEQ ID NO: 1030 - protein, 36 aa, Artificial Sequence
  Core polypeptide
WAAWEQKVRYLEANITALLEQAQIQQEKNEYELQKL

SEQ ID NO: 1031 - protein, 36 aa, Artificial Sequence
  Core polypeptide
WQEAAQKVRYLEANITALLEQAQIQQEKNEYELQKL

SEQ ID NO: 1032 - protein, 36 aa, Artificial Sequence
  Core polypeptide
WQEWAAKVRYLEANITALLEQAQIQQEKNEYELQKL

SEQ ID NO: 1033 - protein, 36 aa, Artificial Sequence
  Core polypeptide
WQEWEQKAAYLEANITALLEQAQIQQEKNEYELQKL

SEQ ID NO: 1034 - protein, 36 aa, Artificial Sequence
  Core polypeptide
WQEWEQKVAALEANITALLEQAQIQQEKNEYELQKL

SEQ ID NO: 1035 - protein, 29 aa, Artificial Sequence
  Core polypeptide
GDEFDASISQVNEKINQSLAFIRKSDELT

SEQ ID NO: 1036 - protein, 29 aa, Artificial Sequence
  Core polypeptide
GDEFDASISQVNEKINQSLAFTRKSDELT

SEQ ID NO: 1037 - protein, 29 aa, Artificial Sequence
  Core polypeptide
GDEFDASISQVNEKTNQSLAFTRKSDELT

SEQ ID NO: 1038 - protein, 29 aa, Artificial Sequence
  Core polypeptide
GDEFDASISQTNEKTNQSLAFTRKSDELT

SEQ ID NO: 1039 - protein, 29 aa, Artificial Sequence
  Core polypeptide
GDEFDASTSQTNEKTNQSLAFTRKSDELT

SEQ ID NO: 1040 - protein, 29 aa, Artificial Sequence
  Core polypeptide
GDEYDASTSQTNEKTNQSLAFTRKSDELT

SEQ ID NO: 1041 - protein, 29 aa, Artificial Sequence
  Core polypeptide
GDEFDEEISQVNEKIEESLAFIRKSDELL

SEQ ID NO: 1042 - protein, 29 aa, Artificial Sequence
  Core polypeptide
GDEFDASISQVNEKINQSLAFIRKSDELA

SEQ ID NO: 1043 - protein, 29 aa, Artificial Sequence
  Core polypeptide
GDEFDASASQANEKANQSLAFARKSDELA

SEQ ID NO: 1044 - protein, 29 aa, Artificial Sequence
  Core polypeptide
GDEFDESISQVNEKIEESLAFTRKSDELL

SEQ ID NO: 1045 - protein, 29 aa, Artificial Sequence
  Core polypeptide
GDEFDESISQVNEKTEESLAFIRKSDELL

SEQ ID NO: 1046 - protein, 29 aa, Artificial Sequence
  Core polypeptide
GDEFDESISQTNEKIEESLAFIRKSDELL

SEQ ID NO: 1047 - protein, 29 aa, Artificial Sequence
  Core polypeptide
GDEFDESTSQVNEKIEESLAFIRKSDELL

SEQ ID NO: 1048 - protein, 36 aa, Artificial Sequence
  Core polypeptide
WNWFDEFDESTSQVNEKIEESLAFIRKSDELLWNWF

SEQ ID NO: 1049 - protein, 36 aa, Artificial Sequence
  Core polypeptide
WNWFDEFDESTSQTNEKIEESLAFIRKSDELLWNWF

SEQ ID NO: 1050 - protein, 36 aa, Artificial Sequence
  Core polypeptide
WNWFDEFDESTSQTNEKTEESLAFIRKSDELLWNWF

SEQ ID NO: 1051 - protein, 36 aa, Artificial Sequence
  Core polypeptide
YTNLIYTLLEESQNQQEKNEQELLELDKWASLWSWF

SEQ ID NO: 1052 - protein, 46 aa, Artificial Sequence
  Core polypeptide
WQEWEQKVRYLEANITALLEQAQIQQEKNEYELQKLDKWASLWNWF

SEQ ID NO: 1053 - protein, 50 aa, Artificial Sequence
  Core polypeptide
NNMTWQEWEQKVRYLEANITALLEQAQIQQEKNEYELQKLDKWASLWNWF

SEQ ID NO: 1054 - protein, 16 aa, Artificial Sequence
  Core polypeptide
WNWFIEESDELLWNWF

SEQ ID NO: 1055 - protein, 11 aa, Artificial Sequence
  Core polypeptide
GFIEESDELLW

SEQ ID NO: 1056 - protein, 11 aa, Artificial Sequence
  Core polypeptide
WFIEESDELLW

SEQ ID NO: 1057 - protein, 17 aa, Artificial Sequence
  Core polypeptide
GFNFFIEESDELLFNFF

SEQ ID NO: 1058 - protein, 7 aa, Artificial Sequence
  Core polypeptide
GESDELW

SEQ ID NO: 1059 - protein, 39 aa, Artificial Sequence
  Core polypeptide
WNWFGDEFDESISQVQEEIEESLAFIEESDELLGGWNWF

SEQ ID NO: 1060 - protein, 48 aa, Artificial Sequence
  Core polypeptide
YTSLIHSLGGDEFDESISQVNEEIEESLAFIEESDELLGGWASLWNWF

SEQ ID NO: 1061 - protein, 29 aa, Artificial Sequence
  Core polypeptide
GDEFDESISQVQEEIEESLAFIEESDELL

SEQ ID NO: 1062 - protein, 53 aa, Artificial Sequence
  Core polypeptide
HQARQLLSSIMQQQNNLLRAIEAQQHLLQLTVWGIKQLQARILAVERYLKDQH

SEQ ID NO: 1063 - protein, 25 aa, Artificial Sequence
  Core polypeptide
CPKYVKQNTLKLATGMRNVPEKQTR

SEQ ID NO: 1064 - protein, 30 aa, Artificial Sequence
  Core polypeptide
GLFGAIAGFIENGWEGMIDGWYGFRHQNSC

SEQ ID NO: 1065 - protein, 7 aa, Artificial Sequence
  Core polypeptide
LNFLGGT

SEQ ID NO: 1066 - protein, 14 aa, Artificial Sequence
  Core polypeptide
LDSWWTSLNFLGGT

SEQ ID NO: 1067 - protein, 21 aa, Artificial Sequence
  Core polypeptide
ILTIPQSLDSWWTSLNFLGGT

SEQ ID NO: 1068 - protein, 28 aa, Artificial Sequence
  Core polypeptide
GFFLLTRILTIPQSLDSWWTSLNFLGGT

SEQ ID NO: 1069 - protein, 39 aa, Artificial Sequence
  Core polypeptide
WQEWEQKITALLEQAQIQQEKNEYELQKLDKWASLWNWF

SEQ ID NO: 1070 - protein, 36 aa, Artificial Sequence
  Core polypeptide
WNWFITALLEQAQIQQEKNEYELQKLDKWASLWNWF

SEQ ID NO: 1071 - protein, 39 aa, Artificial Sequence
  Core polypeptide
WQEWEQKITALLEQAQIQQEKNEYELQKLDKWASLWEWF

SEQ ID NO: 1072 - protein, 36 aa, Artificial Sequence
  Core polypeptide
WQEWEQKVRYLEANITALLEQAQIQQEKIEYELQKL

SEQ ID NO: 1073 - protein, 36 aa, Artificial Sequence
  Core polypeptide
WQEWEQKVRYLEAQITALLEQAQIQQEKIEYELQKL

SEQ ID NO: 1074 - protein, 35 aa, Artificial Sequence
  Core polypeptide
KENKANGTDAKVKLIKQELDKYKNAVTELQLLMQS

SEQ ID NO: 1075 - protein, 35 aa, Artificial Sequence
  Core polypeptide
NIKENKANGTDAKVKLIKQELDKYKNAVTELQLLM

SEQ ID NO: 1076 - protein, 36 aa, Artificial Sequence; identical to SEQ ID NO: 15
  Core polypeptide

SEQ ID NO: 1077 - protein, 37 aa, Artificial Sequence
  Core polypeptide
GWNWFDEFDESISQVQEEIEESLAFIEESDELLWNWF

SEQ ID NO: 1078 - protein, 38 aa, Artificial Sequence
  Core polypeptide
WNWFGDEFDESISQVNEKIEESLAFIEESDELLGWNWF

SEQ ID NO: 1079 - protein, 38 aa, Artificial Sequence
  Core polypeptide
WNWFGDEFDESISQVNEKIEESLAFIRKSDELLGWNWF

SEQ ID NO: 1080 - protein, 36 aa, Artificial Sequence; identical to SEQ ID NO: 1001
  Core polypeptide

SEQ ID NO: 1081 - protein, 36 aa, Artificial Sequence
  Core polypeptide
WNWFDEFDESISQVNEKIEESLAFIEESDELLWNWF

SEQ ID NO: 1082 - protein, 21 aa, Artificial Sequence
  Core polypeptide
EESQNQQEKNEQELLELDKWA

SEQ ID NO: 1083 - protein, 21 aa, Artificial Sequence
  Core polypeptide
EESQNQQEKNEQELLELDKWA

SEQ ID NO: 1084 - protein, 36 aa, Artificial Sequence
  Core polypeptide
CGTTDRSGAPTYSWGANDTDVFVLNNTRPPLGNWFG

SEQ ID NO: 1085 - protein, 28 aa, Artificial Sequence
  Core polypeptide
GVEHRLEANWTRGERADLEDRDRSELSP

SEQ ID NO: 1086 - protein, 27 aa, Artificial Sequence
  Core polypeptide
CVREGNASRAWVAVTPTVATRDGKLPT

SEQ ID NO: 1087 - protein, 20 aa, Artificial Sequence
  Core polypeptide
CFSPRHHWTTQDANASIYPG

SEQ ID NO: 1088 - protein, 33 aa, Artificial Sequence
  Core polypeptide
LQHYREVAAAKSSENDRLRLLLKQMCPSLDVDS

SEQ ID NO: 1089 - protein, 46 aa, Artificial Sequence
  Core polypeptide
WQEWDREISNYTSLITALLEQAQIQQEKNEYELQKLDEWASLWEWF

SEQ ID NO: 1090 - protein, 48 aa, Artificial Sequence
  Core polypeptide
CWQEWDREISNYTSLITALLEQAQIQQEKNEYELQKLDEWASLWEWFC

SEQ ID NO: 1091 - protein, 42 aa, Artificial Sequence
  Core polypeptide
WQEWDREISNYTSLITALLEQAQIQQEKNEYELQKLDEWEWF

SEQ ID NO: 1092 - protein, 44 aa, Artificial Sequence
  Core polypeptide
CWQEWDREISNYTSLITALLEQAQIQQEKNEYELQKLDEWEWFC

SEQ ID NO: 1093 - protein, 26 aa, Artificial Sequence
  Core polypeptide
GQNSQSPTSNHSPTSAPPTAPGYRWA

SEQ ID NO: 1094 - protein, 27 aa, Artificial Sequence
  Core polypeptide
PGSSTTSTGPARTALTTAQGTSLYPSA

SEQ ID NO: 1095 - protein, 39 aa, Artificial Sequence
  Core polypeptide
PGSSTTSTGPARTALTTAQGTSLYPSAAATKPSDGNATA

SEQ ID NO: 1096 - protein, 16 aa, Artificial Sequence
  Core polypeptide
QKQEPIDKELYPLTSL

SEQ ID NO: 1097 - protein, 39 aa, Artificial Sequence
  Core polypeptide
WQEWDREITALLEQAQIQQEKNEYELQKLDKWASLWNWF

SEQ ID NO: 1098 - protein, 39 aa, Artificial Sequence
  Core polypeptide
WQEWDREITALLEQAQIQQEKNEYELQKLDEWASLWEWF

SEQ ID NO: 1099 - protein, 35 aa, Artificial Sequence
  Core polypeptide
WQEWDREITALLEQAQIQQEKNEYELQKLDEWEWF

SEQ ID NO: 1100 - protein, 35 aa, Artificial Sequence
  Core polypeptide
WQEWEREITALLEQAQIQQEKIEYELQKLIEWEWF

SEQ ID NO: 1101 - protein, 35 aa, Artificial Sequence
  Core polypeptide
WQEWEREITALLEQAQIQQEKNEYELQKLIEWEWF

SEQ ID NO: 1102 - protein, 35 aa, Artificial Sequence
  Core polypeptide
WQEWEREITALLEQAQIQQEKIEYELQKLDEWEWF

SEQ ID NO: 1103 - protein, 33 aa, Artificial Sequence
  Core polypeptide
WQEWEITALLEQAQIQQEKNEYELQKLDEWEWF

SEQ ID NO: 1104 - protein, 33 aa, Artificial Sequence
  Core polypeptide
WQEWEITALLEQAQIQQEKNEYELQKLIEWEWF

SEQ ID NO: 1105 - protein, 33 aa, Artificial Sequence
  Core polypeptide
WQEWEITALLEQAQIQQEKIEYELQKLDEWEWF

SEQ ID NO: 1106 - protein, 33 aa, Artificial Sequence
  Core polypeptide
WQEWEITALLEQAQIQQEKIEYELQKLIEWEWF

SEQ ID NO: 1107 - protein, 39 aa, Artificial Sequence
  Core polypeptide
WQEWDREIDEYDASISQVNEKINQALAYIREADELWEWF

SEQ ID NO: 1108 - protein, 39 aa, Artificial Sequence
  Core polypeptide
WQEWEREIDEYDASISQVNEKINQALAYIREADELWEWF

SEQ ID NO: 1109 - protein, 37 aa, Artificial Sequence
  Core polypeptide
WQEWEIDEYDASISQVNEKINQALAYIREADELWEWF

SEQ ID NO: 1110 - protein, 39 aa, Artificial Sequence
  Core polypeptide
WQEWDREIDEYDASISQVNEEINQALAYIREADELWEWF

SEQ ID NO: 1111 - protein, 39 aa, Artificial Sequence
  Core polypeptide
WQEWEREIDEYDASISQVNEEINQALAYIREADELWEWF

SEQ ID NO: 1112 - protein, 37 aa, Artificial Sequence
  Core polypeptide
WQEWEIDEYDASISQVNEEINQALAYIREADELWEWF

SEQ ID NO: 1113 - protein, 35 aa, Artificial Sequence
  Core polypeptide
WQEWDEYDASISQVNEKINQALAYIREADELWEWF

SEQ ID NO: 1114 - protein, 35 aa, Artificial Sequence
  Core polypeptide
WQEWDEYDASISQVNEEINQALAYIREADELWEWF

SEQ ID NO: 1115 - protein, 35 aa, Artificial Sequence
  Core polypeptide
WQEWEQKITALLEQAQIQQEKIEYELQKLIEWEWF

SEQ ID NO: 1116 - protein, 39 aa, Artificial Sequence
  Core polypeptide
WQEWEQKITALLEQAQIQQEKIEYELQKLIEWASLWEWF

SEQ ID NO: 1117 - protein, 37 aa, Artificial Sequence
  Core polypeptide
WQEWEITALLEQAQIQQEKIEYELQKLIEWASLWEWF

SEQ ID NO: 1118 - protein, 44 aa, Artificial Sequence
  Core polypeptide
NHTTWMEWDREINNYTSLIHSLIEESQNQQEKNEQELLELDKWH

SEQ ID NO: 1119 - protein, 52 aa, Artificial Sequence
  Core polypeptide
QARQLLSGIVQQQNNLLRAIEAQQHLLQLTVWGIKQLQARILAVERYLKDQH

SEQ ID NO: 1120 - protein, 40 aa, Artificial Sequence
  Core polypeptide
WVYPSDEYDASISQVNEEINQALAYIRKADELLENVWNWF

SEQ ID NO: 1121 - protein, 36 aa, Artificial Sequence; identical to SEQ ID NO: 15
  Core polypeptide

SEQ ID NO: 1122 - protein, 35 aa, Artificial Sequence
  Core polypeptide
WQEWDEYDASISQVNEKINQALAYIREADELWAWF

SEQ ID NO: 1123 - protein, 35 aa, Artificial Sequence
  Core polypeptide
WQAWDEYDASISQVNEKINQALAYIREADELWAWF

SEQ ID NO: 1124 - protein, 35 aa, Artificial Sequence
  Core polypeptide
WQAWDEYDASISQVNEKINQALAYIREADELWEWF

SEQ ID NO: 1125 - protein, 35 aa, Artificial Sequence; identical to SEQ ID NO: 104
  Core polypeptide

SEQ ID NO: 1126 - protein, 28 aa, Artificial Sequence
  Core polypeptide
YDPLVFPSDEFDASISQVNEKINQSLAF

SEQ ID NO: 1127 - protein, 29 aa, Artificial Sequence
  Core polypeptide
QVNEKINQSLAFIRKSDELLHNVNAGKST

SEQ ID NO: 1128 - protein, 8 aa, Artificial Sequence
  Core polypeptide
WMEWDREI

SEQ ID NO: 1129 - protein, 8 aa, Artificial Sequence
  Core polypeptide
WQEWEQKI

SEQ ID NO: 1130 - protein, 39 aa, Artificial Sequence
  Core polypeptide
WQEWEQKITALLEQAQIQQEKIEYELQKLIKWASLWEWF

SEQ ID NO: 1131 - protein, 39 aa, Artificial Sequence; identical to SEQ ID NO: 1116
  Core polypeptide

SEQ ID NO: 1132 - protein, 42 aa, Artificial Sequence
  Core polypeptide
WQEWEREISAYTSLITALLEQAQIQQEKIEYELQKLIEWEWF

SEQ ID NO: 1133 - protein, 40 aa, Artificial Sequence
  Core polypeptide
WQEWEREISAYTSLITALLEQAQIQQEKIEYELQKEWEWF

SEQ ID NO: 1134 - protein, 39 aa, Artificial Sequence
  Core polypeptide
WQEWEREISAYTSLITALLEQAQIQQEKIEYELQKEWEW

SEQ ID NO: 1135 - protein, 41 aa, Artificial Sequence
  Core polypeptide
WQEWEREISAYTSLITALLEQAQIQQEKIEYELQKLIEWEW

SEQ ID NO: 1136 - protein, 36 aa, Artificial Sequence
  Core polypeptide
FNLSDHSESIQKKFQLMKKHVNKIGVDSDPIGSWLR

SEQ ID NO: 1137 - protein, 35 aa, Artificial Sequence
  Core polypeptide
DHSESIQKKFQLMKKHVNKIGVDSDPIGSWLRGIF

SEQ ID NO: 1138 - protein, 40 aa, Artificial Sequence
  Core polypeptide
WSVKQANLTTSLLGDLLDDVTSIRHAVLQNRAWMEWDREI

SEQ ID NO: 1139 - protein, 18 aa, Artificial Sequence
  Core polypeptide
NNMTWMEWDREINNYTSL

SEQ ID NO: 1140 - protein, 36 aa, Artificial Sequence
  Core polypeptide
GAASLTLTVQARQLLSGIVQQQNNLLRAIEAQQHLL

SEQ ID NO: 1141 - protein, 36 aa, Artificial Sequence
  Core polypeptide
ASLTLTVQARQLLSGIVQQQNNLLRAIEAQQHLLQL

SEQ ID NO: 1142 - protein, 34 aa, Artificial Sequence
  Core polypeptide
VSVGNTLYYVNKQEGKSLYVKGEPIINFYDPLVF

SEQ ID NO: 1143 - protein, 10 aa, Artificial Sequence
  Core polypeptide
QHWSYGLRPG

SEQ ID NO: 1144 - protein, 26 aa, Artificial Sequence
  Core polypeptide
WQEWEQKIQHWSYGLRPGWASLWEWF

SEQ ID NO: 1145 - protein, 22 aa, Artificial Sequence
  Core polypeptide
WQEWEQKIQHWSYGLRPGWEWF

SEQ ID NO: 1146 - protein, 18 aa, Artificial Sequence
  Core polypeptide
WNWFQHWSYGLRPGWNWF

SEQ ID NO: 1147 - protein, 18 aa, Artificial Sequence
  Core polypeptide
FNFFQHWSYGLRPGFNFF

SEQ ID NO: 1148 - protein, 18 aa, Artificial Sequence
  Core polypeptide
GAGAQHWSYGLRPGAGAG

SEQ ID NO: 1149 - protein, 39 aa, Artificial Sequence
  Core polypeptide
WQEWEQKITALLEQAQIQQEKIEYELQKLAKWASLWEWF

SEQ ID NO: 1150 - protein, 39 aa, Artificial Sequence
  Core polypeptide
WQEWEQKITALLEQAQIQQEKIEYELQKLAEWASLWEWF

SEQ ID NO: 1151 - protein, 39 aa, Artificial Sequence
  Core polypeptide
WQEWEQKITALLEQAQIQQEKAEYELQKLAEWASLWEWF

SEQ ID NO: 1152 - protein, 39 aa, Artificial Sequence
  Core polypeptide
WQEWEQKITALLEQAQIQQEKAEYELQKLAEWASLWAWF

SEQ ID NO: 1153 - protein, 39 aa, Artificial Sequence
  Core polypeptide
WQEWEQKITALLEQAQIQQEKAEYELQKLAKWASLWAWF

SEQ ID NO: 1154 - protein, 36 aa, Artificial Sequence
  Core polypeptide
TNKAVVSLSNGVSVLTSKVLDLKNYIDKQLLPIVNK

SEQ ID NO: 1155 - protein, 36 aa, Artificial Sequence
  Core polypeptide
KAVVSLSNGVSVLTSKVLDLKNYIDKQLLPIVNKQS

SEQ ID NO: 1156 - protein, 35 aa, Artificial Sequence
  Core polypeptide
WQEWEQKITALLEQAQIQQEKNEYELQKLIEWEWF

SEQ ID NO: 1157 - protein, 35 aa, Artificial Sequence
  Core polypeptide
WQEWEQKITALLEQAQIQQEKGEYELQKLIEWEWF

SEQ ID NO: 1158 - protein, 35 aa, Artificial Sequence
  Core polypeptide
WQEWEQKITALLEQAQIQQEKIEYELQKLDKWEWF

SEQ ID NO: 1159 - protein, 28 aa, Artificial Sequence
  Core polypeptide
YDPLVFPSDEFDASISQVNEKINQSLAF

SEQ ID NO: 1160 - protein, 35 aa, Artificial Sequence; identical to SEQ ID NO: 692
  Core polypeptide

SEQ ID NO: 1161 - protein, 36 aa, Artificial Sequence; identical to SEQ ID NO: 15
  Core polypeptide

SEQ ID NO: 1162 - protein, 36 aa, Artificial Sequence
  Core polypeptide
SGIVQQQNNLLRAIEAQQHLLQLTVWGIKQLQARIL

SEQ ID NO: 1163 - protein, 41 aa, Artificial Sequence
  Core polypeptide
QQQNNLLRAIEAQQHLLQLTVWGIKQLQARILAVERYLKDQ

SEQ ID NO: 1164 - protein, 45 aa, Artificial Sequence
  Core polypeptide
SGIVQQQNNLLRAIEAQQHLLQLTVWGIKQLQARILAVERYLKDQ

SEQ ID NO: 1165 - protein, 39 aa, Artificial Sequence
  Core polypeptide
WQEWEQKITALLEQAQIQQEKNEYELQKLAEWASLWAWF

SEQ ID NO: 1166 - protein, 38 aa, Artificial Sequence
  Core polypeptide
WQEWEQKITALLEQAQIQQEKNEYELQKLAEWASLWAW

SEQ ID NO: 1167 - protein, 38 aa, Artificial Sequence
  Core polypeptide
WQEWEQKITALLEQAQIQQEKAEYELQKLAEWASLWAW

SEQ ID NO: 1168 - protein, 39 aa, Artificial Sequence
  Core polypeptide
WQEWEQKITALLEQAQIQQEKNEYELQKLAEWAGLWAWF

SEQ ID NO: 1169 - protein, 38 aa, Artificial Sequence
  Core polypeptide
WQEWEQKITALLEQAQIQQEKNEYELQKLAEWAGLWAW

SEQ ID NO: 1170 - protein, 38 aa, Artificial Sequence
  Core polypeptide
WQEWEQKITALLEQAQIQQEKAEYELQKLAEWAGLWAW

SEQ ID NO: 1171 - protein, 39 aa, Artificial Sequence
  Core polypeptide
WQEWEQKITALLEQAQIQQEKNEYELQKLDKWAGLWEWF

SEQ ID NO: 1172 - protein, 18 aa, Artificial Sequence
  Core polypeptide
WQEWQHWSYGLRPGWEWF

SEQ ID NO: 1173 - protein, 18 aa, Artificial Sequence
  Core polypeptide
WQAWQHWSYGLRPGWAWF

SEQ ID NO: 1174 - protein, 39 aa, Artificial Sequence; identical to SEQ ID NO: 1071
  Core polypeptide

SEQ ID NO: 1175 - protein, 39 aa, Artificial Sequence; identical to SEQ ID NO: 1071
  Core polypeptide

SEQ ID NO: 1176 - protein, 35 aa, Artificial Sequence; identical to SEQ ID NO: 1115
  Core polypeptide

SEQ ID NO: 1177 - protein, 34 aa, Artificial Sequence
  Core polypeptide
WQEWEQKIALLEQAQIQQEKIEYELQKLIEWEWF

SEQ ID NO: 1178 - protein, 38 aa, Artificial Sequence
  Core polypeptide
WQEWEQKIALLEQAQIQQEKNEYELQKLDKWASLWEWF

SEQ ID NO: 1179 - protein, 38 aa, Artificial Sequence
  Core polypeptide
AGSTMGARSMTLTVQARQLLSGIVQQQNNLLRAIEAQQ

SEQ ID NO: 1180 - protein, 38 aa, Artificial Sequence
  Core polypeptide
AGSAMGAASLTLSAQSRTLLAGIVQQQQQLLDVVKRQQ

SEQ ID NO: 1181 - protein, 38 aa, Artificial Sequence
  Core polypeptide
AGSAMGAASTALTAQSRTLLAGIVQQQQQLLDVVKRQQ

SEQ ID NO: 1182 - protein, 38 aa, Artificial Sequence
  Core polypeptide
ALTAQSRTLLAGIVQQQQQLLDVVKRQQELLRLTVWGT

SEQ ID NO: 1183 - protein, 38 aa, Artificial Sequence
  Core polypeptide
TLSAQSRTLLAGIVQQQQQLLDVVKRQQEMLRLTVWGT

SEQ ID NO: 1184 - protein, 38 aa, Artificial Sequence
  Core polypeptide
TLTVQARQLLSGIVQQQNNLLRAIEAQQHLLQLTVWGI

SEQ ID NO: 1185 - protein, 35 aa, Artificial Sequence
  Core polypeptide
WQAWIEYEAELSQVKEKIEQSLAYIREADELWAWF

SEQ ID NO: 1186 - protein, 35 aa, Artificial Sequence
  Core polypeptide
WQAWIEYEASLSQAKEKIEESKAYIREADELWAWF

SEQ ID NO: 1187 - protein, 35 aa, Artificial Sequence
  Core polypeptide
WQAWIEYERLLVQAKLKIAIAKLYIAKELLEWAWF

SEQ ID NO: 1188 - protein, 35 aa, Artificial Sequence
  Core polypeptide
WQAWIEYERLLVQVKLKIAIALLYIAKELLEWAWF

SEQ ID NO: 1189 - protein, 35 aa, Artificial Sequence
  Core polypeptide
WQAWIELERLLVQVKLKLAIAKLEIAKELLEWAWF

SEQ ID NO: 1190 - protein, 19 aa, Artificial Sequence
  Core polypeptide
GEWTYDDATKTFTVTEGGH

SEQ ID NO: 1191 - protein, 35 aa, Artificial Sequence
  Core polypeptide
WQEWEQKIGEWTYDDATKTFTVTEGGHWASLWEWF

SEQ ID NO: 1192 - protein, 16 aa, Artificial Sequence
  Core polypeptide
GEWTYDDATKTFTVTE

SEQ ID NO: 1193 - protein, 32 aa, Artificial Sequence
  Core polypeptide
WQEWEQKIGEWTYDDATKTFTVTEWASLWEWF

SEQ ID NO: 1194 - protein, 8 aa, Artificial Sequence
  Core polypeptide
MHRFDYRT

SEQ ID NO: 1195 - protein, 24 aa, Artificial Sequence
  Core polypeptide
WQEWEQKIMHRFDYRTWASLWEWF

SEQ ID NO: 1196 - protein, 11 aa, Artificial Sequence
  Core polypeptide
MHRFNWSTGGG

SEQ ID NO: 1197 - protein, 27 aa, Artificial Sequence
  Core polypeptide
WQEWEQKIMHRFNWSTGGGWASLWEWF

SEQ ID NO: 1198 - protein, 8 aa, Artificial Sequence
  Core polypeptide
MHRFNWST

SEQ ID NO: 1199 - protein, 24 aa, Artificial Sequence
  Core polypeptide
WQEWEQKIMHRFNWSTWASLWEWF

SEQ ID NO: 1200 - protein, 18 aa, Artificial Sequence
  Core polypeptide
LLVPLARIMTMSSVHGGG

SEQ ID NO: 1201 - protein, 34 aa, Artificial Sequence
  Core polypeptide
WQEWEQKILLVPLARIMTMSSVHGGGWASLWEWF

SEQ ID NO: 1202 - protein, 15 aa, Artificial Sequence
  Core polypeptide
LLVPLARIMTMSSVH

SEQ ID NO: 1203 - protein, 31 aa, Artificial Sequence
  Core polypeptide
WQEWEQKILLVPLARIMTMSSVHWASLWEWF

SEQ ID NO: 1204 - protein, 23 aa, Artificial Sequence
  Core polypeptide
TALLEQAQIQQEKNEYELQKLDK

SEQ ID NO: 1205 - protein, 23 aa, Artificial Sequence
  Core polypeptide
TALLEQAQIQQEKNEYELQKLDK

SEQ ID NO: 1206 - protein, 23 aa, Artificial Sequence
  Core polypeptide
TALLEQAQIQQEKIEYELQKLIE

SEQ ID NO: 1207 - protein, 23 aa, Artificial Sequence
  Core polypeptide
TALLEQAQIQQEKIEYELQKLIE

SEQ ID NO: 1208 - protein, 47 aa, Artificial Sequence
  Core polypeptide
QARQLLSGIVQQQNNLLRAIEAQQHLLQLTVWGIKQLQARILAVERY

SEQ ID NO: 1209 - protein, 47 aa, Artificial Sequence; identical to SEQ ID NO: 1208
  Core polypeptide

SEQ ID NO: 1210 - protein, 36 aa, Artificial Sequence
  Core polypeptide
GAASLTLSAQSRTLLAGIVQQQQQLLDVVKRQQEML

SEQ ID NO: 1211 - protein, 40 aa, Artificial Sequence
  Core polypeptide
GSAMGAASLTLSAQSRTLLAGIVQQQQQLLDVVKRQQEML

SEQ ID NO: 1212 - protein, 36 aa, Artificial Sequence
  Core polypeptide
PALSTGLIHLHQNIVDVQFLFGVGSSIASWAIKWEY

SEQ ID NO: 1213 - protein, 33 aa, Artificial Sequence
  Core polypeptide
PALSTGLIHLHQNIVDVQFLYGVGSSIASWAIK

SEQ ID NO: 1214 - protein, 34 aa, Artificial Sequence
  Core polypeptide
LSTTQWQVLPSFTTLPALSTGLIHLHQNIVDVQY

SEQ ID NO: 1215 - protein, 31 aa, Artificial Sequence
  Core polypeptide
FRKFPEATFSRGSGPRITPRMVDFPFRLWHY

SEQ ID NO: 1216 - protein, 37 aa, Artificial Sequence
  Core polypeptide
DFPFRLWHFPTINYTIFKVRLFVGGVEHRLEAANWTR

SEQ ID NO: 1217 - protein, 32 aa, Artificial Sequence
  Core polypeptide
YVGGVEHRLEAANWTRGERDLEDRDRSELSPL

SEQ ID NO: 1218 - protein, 36 aa, Artificial Sequence
  Core polypeptide
MVYPSDEYDASISQVNEEINQALAYIRKADELLENV

SEQ ID NO: 1219 - protein, 36 aa, Artificial Sequence; identical to SEQ ID NO: 1218
  Core polypeptide

SEQ ID NO: 1220 - protein, 35 aa, Artificial Sequence
  Core polypeptide
GPLLVLQAGFFLLTRILTIPQSLDSWWTSLNFLGG

SEQ ID NO: 1221 - protein, 35 aa, Artificial Sequence
  Core polypeptide
LGPLLVLQAGFFLLTRILTIPQSLDSWWTSLNFLG

SEQ ID NO: 1222 - protein, 35 aa, Artificial Sequence
  Core polypeptide
FLGPLLVLQAGFFLLTRILTIPQSLDSWWTSLNFL

SEQ ID NO: 1223 - protein, 36 aa, Artificial Sequence
  Core polypeptide
YTSLIGSLIEESQIQQERNEQELLELDRWASLWEWF

SEQ ID NO: 1224 - protein, 34 aa, Artificial Sequence
  Core polypeptide
VYPSDEYDASISQVNEEINQALAYIRKADELLEH

SEQ ID NO: 1225 - protein, 33 aa, Artificial Sequence
  Core polypeptide
VYPSDEYDASISQVNEEINQALAYIRKADELLH

SEQ ID NO: 1226 - protein, 32 aa, Artificial Sequence
  Core polypeptide
VYPSDEYDASISQVNEEINQALAYIRKADELH

SEQ ID NO: 1227 - protein, 34 aa, Artificial Sequence
  Core polypeptide
YPSDEYDASISQVNEEINQALAYIRKADELLENV

SEQ ID NO: 1228 - protein, 33 aa, Artificial Sequence
  Core polypeptide
PSDEYDASISQVNEEINQALAYIRKADELLENV

SEQ ID NO: 1229 - protein, 32 aa, Artificial Sequence
  Core polypeptide
SDEYDASISQVNEEINQALAYIRKADELLENV

SEQ ID NO: 1230 - protein, 31 aa, Artificial Sequence
  Core polypeptide
DEYDASISQVNEEINQALAYIRKADELLENV

SEQ ID NO: 1231 - protein, 35 aa, Artificial Sequence
  Core polypeptide
VYPSDEYDASISQVDEEINQALAYIRKADELLENV

SEQ ID NO: 1232 - protein, 35 aa, Artificial Sequence
  Core polypeptide
VYPSDEYDASISQVNEEIDQALAYIRKADELLENV

SEQ ID NO: 1233 - protein, 35 aa, Artificial Sequence
  Core polypeptide
VYPSDEYDASISQVNEEINQALAYIRKADELLEDV

SEQ ID NO: 1234 - protein, 35 aa, Artificial Sequence
  Core polypeptide
VYPSDEYDASISQVDEEIDQALAYIRKADELLENV

SEQ ID NO: 1235 - protein, 35 aa, Artificial Sequence
  Core polypeptide
LLSTNKAVVSLSNGVSVLTSKVLDLKNYIDKQLLP

SEQ ID NO: 1236 - protein, 35 aa, Artificial Sequence
  Core polypeptide
LSTNKAVVSLSNGVSVLTSKVLDLKNYIDKQLLPI

SEQ ID NO: 1237 - protein, 35 aa, Artificial Sequence; identical to SEQ ID NO: 692
  Core polypeptide

SEQ ID NO: 1238 - protein, 27 aa, Artificial Sequence
  Core polypeptide
DEYDASISQVNEEINQALAYIREADEL

SEQ ID NO: 1239 - protein, 27 aa, Artificial Sequence
  Core polypeptide
DEYDASISQVNEKINQALAYIREADEL

SEQ ID NO: 1240 - protein, 35 aa, Artificial Sequence
  Core polypeptide
DDECLNSVKNGTYDFPKFEEESKLNRNEIKGVKLS

SEQ ID NO: 1241 - protein, 36 aa, Artificial Sequence
  Core polypeptide
DDEABLNSVKNGTYDFPKFEEESKLNRNEIKGVKLS

SEQ ID NO: 1242 - protein, 40 aa, Artificial Sequence
  Core polypeptide
YHKCDDECLNSVKNGTFDFPKFEEESKLNRNEIKGVKLSS

SEQ ID NO: 1243 - protein, 42 aa, Artificial Sequence
  Core polypeptide
YHKABDDEABLNSVKNGTFDFPKFEEESKLNRNEIKGVKLSS

SEQ ID NO: 1244 - protein, 36 aa, Artificial Sequence
  Core polypeptide
YTSLIHSLIEESQIQQEKNEYELQKLDKWASLWNWF

SEQ ID NO: 1245 - protein, 36 aa, Artificial Sequence
  Core polypeptide
YTSLIHSLIEESQNQQEKNEQELQKLDKWASLWNWF

SEQ ID NO: 1246 - protein, 36 aa, Artificial Sequence
  Core polypeptide
YTSLIHSLIEESQNQQEKNEYELQKLDKWASLWNWF

SEQ ID NO: 1247 - protein, 36 aa, Artificial Sequence
  Core polypeptide
YTSLIHSLIEESQIQQEKNEQELQKLDKWASLWNWF

SEQ ID NO: 1248 - protein, 36 aa, Artificial Sequence
  Core polypeptide
YTSLIHSLIEESQNQQEKNEQELLELDKWASLWEWF

SEQ ID NO: 1249 - protein, 36 aa, Artificial Sequence
  Core polypeptide
YTSLIHSLIEESQIQQEKNEQELLELDKWASLWEWF

SEQ ID NO: 1250 - protein, 36 aa, Artificial Sequence
  Core polypeptide
YTSLIHSLIEESQNQQEKNEYELLELDKWASLWEWF

SEQ ID NO: 1251 - protein, 36 aa, Artificial Sequence
  Core polypeptide
YTSLIHSLIEESQIQQEKNEYELLELDKWASLWEWF

SEQ ID NO: 1252 - protein, 36 aa, Artificial Sequence
  Core polypeptide
YTSLIHSLIEESQIQQEKNEYELQKLDKWASLWEWF

SEQ ID NO: 1253 - protein, 36 aa, Artificial Sequence
  Core polypeptide
YTSLIHSLIEESQNQQEKNEQELQKLDKWASLWEWF

SEQ ID NO: 1254 - protein, 36 aa, Artificial Sequence
  Core polypeptide
YTSLIHSLIEESQNQQEKNEYELQKLDKWASLWEWF

SEQ ID NO: 1255 - protein, 36 aa, Artificial Sequence
  Core polypeptide
YTSLIHSLIEESQIQQEKNEQELQKLDKWASLWEWF

SEQ ID NO: 1256 - protein, 39 aa, Artificial Sequence
  Core polypeptide
WQEWEQKITALLEQAQIQQEKNEYELQKLAKWASLWEWF

SEQ ID NO: 1257 - protein, 39 aa, Artificial Sequence
  Core polypeptide
WQEWEQKITALLEQAQIQQEKNEYELQKLIKWASLWEWF

SEQ ID NO: 1258 - protein, 39 aa, Artificial Sequence
  Core polypeptide
WQEWEQKITALLEQAQIQQEKNEYELQKLIEWAGLWEWF

SEQ ID NO: 1259 - protein, 39 aa, Artificial Sequence
  Core polypeptide
WQEWEQKITALLEQAQIQQEKNEYELQKLIKWAGLWEWF

SEQ ID NO: 1260 - protein, 39 aa, Artificial Sequence
  Core polypeptide
WQEWEQKITALLEQAQIQQEKNEYELQKLAKWAGLWEWF

SEQ ID NO: 1261 - protein, 39 aa, Artificial Sequence
  Core polypeptide
WQEWEQKITALLEQAQIQQEKNEYELQKLIEWAGLWAWF

SEQ ID NO: 1262 - protein, 39 aa, Artificial Sequence
  Core polypeptide
WQEWEQKITALLEQAQIQQEKNEYELQKLAKWAGLWAWF

SEQ ID NO: 1263 - protein, 39 aa, Artificial Sequence
  Core polypeptide
WQEWEQKITALLEQAQIQQEKNEYELQKLIKWAGLWAWF

SEQ ID NO: 1264 - protein, 35 aa, Artificial Sequence
  Core polypeptide
WQEWEQKITALLEQAQIQQEKGEYELQKLDKWEWF

SEQ ID NO: 1265 - protein, 35 aa, Artificial Sequence
  Core polypeptide
WQEWEQKITALLEQAQIQQEKGEYELLELDKWEWF

SEQ ID NO: 1266 - protein, 35 aa, Artificial Sequence
  Core polypeptide
WQEWEQKITALLEQAQIQQEKGEYELQKLAKWEWF

SEQ ID NO: 1267 - protein, 35 aa, Artificial Sequence
  Core polypeptide
WQEWEQKITALLEQAQIQQEKGEYELQKLDEWEWF

SEQ ID NO: 1268 - protein, 35 aa, Artificial Sequence
  Core polypeptide
WQEWEQKITALLEQAQIQQEKGEYELLELAKWEWF

SEQ ID NO: 1269 - protein, 35 aa, Artificial Sequence
  Core polypeptide
WQEWEQKITALLEQAQIQQEKNEYELLELDKWEWF

SEQ ID NO: 1270 - protein, 39 aa, Artificial Sequence
  Core polypeptide
WQEWEQKITALLEQAQIQQEKNEYELLELIEWASLWEWF

SEQ ID NO: 1271 - protein, 39 aa, Artificial Sequence
  Core polypeptide
WQEWEQKITALLEQAQIQQEKNEYELLELIEWAGLWEWF

SEQ ID NO: 1272 - protein, 39 aa, Artificial Sequence
  Core polypeptide
WQEWEQKITALLEQAQIQQEKNEYELLELIEWAGLWAWF

SEQ ID NO: 1273 - protein, 39 aa, Artificial Sequence
  Core polypeptide
WQEWEREITALLEQAQIQQEKNEYELQKLIEWASLWEWF

SEQ ID NO: 1274 - protein, 30 aa, Artificial Sequence
  Core polypeptide
WQEWEREIQQEKNEYELQKLDKWASLWEWF

SEQ ID NO: 1275 - protein, 25 aa, Artificial Sequence
  Core polypeptide
WQEWEREIQQEKGEYELQKLEWEWF

SEQ ID NO: 1276 - protein, 29 aa, Artificial Sequence
  Core polypeptide
WQEWQAQIQQEKNEYELQKLDWASLWEWF

SEQ ID NO: 1277 - protein, 26 aa, Artificial Sequence
  Core polypeptide
WQEWQAQIQQEKGEYELQKLIEWEWF

SEQ ID NO: 1278 - protein, 28 aa, Artificial Sequence
  Core polypeptide
YTSLIHSLIEESQNQQEKNEQELLELDK

SEQ ID NO: 1279 - protein, 28 aa, Artificial Sequence
  Core polypeptide
LEENITALLEEAQIQQEKNMYELQKLNS

SEQ ID NO: 1280 - protein, 28 aa, Artificial Sequence
  Core polypeptide
LEANISQSLEQAQIQQEKNMYELQKLNS

SEQ ID NO: 1281 - protein, 28 aa, Artificial Sequence
  Core polypeptide
NNYTSLIHSLIEESQNQQEKNEQELLEL

SEQ ID NO: 1282 - protein, 28 aa, Artificial Sequence
  Core polypeptide
DFLEENITALLEEAQIQQEKNMYELQKL

SEQ ID NO: 1283 - protein, 28 aa, Artificial Sequence
  Core polypeptide
RYLEANISQSLEQAQIQQEKNMYELQKL

SEQ ID NO: 1284 - protein, 28 aa, Artificial Sequence
  Core polypeptide
RYLEANITALLEQAQIQQEKNEYELQKL

SEQ ID NO: 1285 - protein, 30 aa, Artificial Sequence
  Core polypeptide
NNYTSLIHSLIEESQNQQEKNEQELLELDK

SEQ ID NO: 1286 - protein, 23 aa, Artificial Sequence
  Core polypeptide
TALLEQAQIQQEKNEYELQKLDK

SEQ ID NO: 1287 - protein, 23 aa, Artificial Sequence
  Core polypeptide
TALLEQAQIQQEKNEYELQKLDE

SEQ ID NO: 1288 - protein, 23 aa, Artificial Sequence
  Core polypeptide
TALLEQAQIQQEKNEYELQKLIE

SEQ ID NO: 1289 - protein, 23 aa, Artificial Sequence
  Core polypeptide
TALLEQAQIQQEKIEYELQKLDK

SEQ ID NO: 1290 - protein, 23 aa, Artificial Sequence
  Core polypeptide
TALLEQAQIQQEKIEYELQKLDE

SEQ ID NO: 1291 - protein, 23 aa, Artificial Sequence
  Core polypeptide
TALLEQAQIQQEKIEYELQKLIE

SEQ ID NO: 1292 - protein, 22 aa, Artificial Sequence
  Core polypeptide
TALLEQAQIQQEKIEYELQKLE

SEQ ID NO: 1293 - protein, 23 aa, Artificial Sequence
  Core polypeptide
TALLEQAQIQQEKIEYELQKLAK

SEQ ID NO: 1294 - protein, 23 aa, Artificial Sequence
  Core polypeptide
TALLEQAQIQQEKIEYELQKLAE

SEQ ID NO: 1295 - protein, 22 aa, Artificial Sequence
  Core polypeptide
TALLEQAQIQQEKAEYELQKLE

SEQ ID NO: 1296 - protein, 22 aa, Artificial Sequence
  Core polypeptide
TALLEQAQIQQEKNEYELQKLE

SEQ ID NO: 1297 - protein, 22 aa, Artificial Sequence
  Core polypeptide
TALLEQAQIQQEKGEYELQKLE

SEQ ID NO: 1298 - protein, 23 aa, Artificial Sequence
  Core polypeptide
TALLEQAQIQQEKAEYELQKLAK

SEQ ID NO: 1299 - protein, 23 aa, Artificial Sequence
  Core polypeptide
TALLEQAQIQQEKNEYELQKLAK

SEQ ID NO: 1300 - protein, 23 aa, Artificial Sequence
  Core polypeptide
TALLEQAQIQQEKGEYELQKLAK

SEQ ID NO: 1301 - protein, 23 aa, Artificial Sequence
  Core polypeptide
TALLEQAQIQQEKAEYELQKLAE

SEQ ID NO: 1302 - protein, 23 aa, Artificial Sequence
  Core polypeptide
TALLEQAQIQQEKNEYELQKLAE

SEQ ID NO: 1303 - protein, 23 aa, Artificial Sequence
  Core polypeptide
TALLEQAQIQQEKGEYELQKLAE

SEQ ID NO: 1304 - protein, 28 aa, Artificial Sequence
  Core polypeptide
DEFDASISQVNEKINQSLAFIRKSDELL

SEQ ID NO: 1305 - protein, 27 aa, Artificial Sequence
  Core polypeptide
DEYDASISQVNEKINQALAYIREADEL

SEQ ID NO: 1306 - protein, 27 aa, Artificial Sequence
  Core polypeptide
DEYDASISQVNEEINQALAYIRKADEL

SEQ ID NO: 1307 - protein, 28 aa, Artificial Sequence
  Core polypeptide
DEFDESISQVNEKIEESLAFIRKSDELL

SEQ ID NO: 1308 - protein, 27 aa, Artificial Sequence
  Core polypeptide
DEFDESISQVNEKIEESLAFIRKSDEL

SEQ ID NO: 1309 - protein, 10 aa, Artificial Sequence
  Core polypeptide
QHWSYGLRPG

SEQ ID NO: 1310 - protein, 39 aa, Artificial Sequence; identical to SEQ ID NO: 1071
  Core polypeptide

SEQ ID NO: 1311 - protein, 35 aa, Artificial Sequence; identical to SEQ ID NO: 1115
  Core polypeptide

SEQ ID NO: 1312 - protein, 35 aa, Artificial Sequence; identical to SEQ ID NO: 692
  Core polypeptide

SEQ ID NO: 1313 - protein, 28 aa, Artificial Sequence
  Core polypeptide
YTSLIHSLIEESQNQQEKNEQELLELDK

SEQ ID NO: 1314 - protein, 28 aa, Artificial Sequence
  Core polypeptide
LEENITALLEEAQIQQEKNMYELQKLNS

SEQ ID NO: 1315 - protein, 28 aa, Artificial Sequence
  Core polypeptide
LEANISQSLEQAQIQQEKNMYELQKLNS

SEQ ID NO: 1316 - protein, 28 aa, Artificial Sequence
  Core polypeptide
NNYTSLIHSLIEESQNQQEKNEQELLEL

SEQ ID NO: 1317 - protein, 28 aa, Artificial Sequence
  Core polypeptide
DFLEENITALLEEAQIQQEKNMYELQKL

SEQ ID NO: 1318 - protein, 28 aa, Artificial Sequence
  Core polypeptide
RYLEANISQSLEQAQIQQEKNMYELQKL

SEQ ID NO: 1319 - protein, 28 aa, Artificial Sequence
  Core polypeptide
RYLEANITALLEQAQIQQEKNEYELQKL

SEQ ID NO: 1320 - protein, 30 aa, Artificial Sequence; identical to SEQ ID NO: 1285
  Core polypeptide

SEQ ID NO: 1321 - protein, 23 aa, Artificial Sequence
  Core polypeptide
TALLEQAQIQQEKNEYELQKLDK

SEQ ID NO: 1322 - protein, 23 aa, Artificial Sequence
  Core polypeptide
TALLEQAQIQQEKNEYELQKLDE

SEQ ID NO: 1323 - protein, 23 aa, Artificial Sequence
  Core polypeptide
TALLEQAQIQQEKNEYELQKLIE

SEQ ID NO: 1324 - protein, 23 aa, Artificial Sequence
  Core polypeptide
TALLEQAQIQQEKIEYELQKLDK

SEQ ID NO: 1325 - protein, 23 aa, Artificial Sequence
  Core polypeptide
TALLEQAQIQQEKIEYELQKLDE

SEQ ID NO: 1326 - protein, 23 aa, Artificial Sequence
  Core polypeptide
TALLEQAQIQQEKIEYELQKLIE

SEQ ID NO: 1327 - protein, 22 aa, Artificial Sequence
  Core polypeptide
TALLEQAQIQQEKIEYELQKLE

SEQ ID NO: 1328 - protein, 23 aa, Artificial Sequence
  Core polypeptide
TALLEQAQIQQEKIEYELQKLAK

SEQ ID NO: 1329 - protein, 23 aa, Artificial Sequence
  Core polypeptide
TALLEQAQIQQEKIEYELQKLAE

SEQ ID NO: 1330 - protein, 22 aa, Artificial Sequence
  Core polypeptide
TALLEQAQIQQEKAEYELQKLE

SEQ ID NO: 1331 - protein, 22 aa, Artificial Sequence
  Core polypeptide
TALLEQAQIQQEKNEYELQKLE

SEQ ID NO: 1332 - protein, 22 aa, Artificial Sequence
  Core polypeptide
TALLEQAQIQQEKGEYELQKLE

SEQ ID NO: 1333 - protein, 23 aa, Artificial Sequence
  Core polypeptide
TALLEQAQIQQEKAEYELQKLAK

SEQ ID NO: 1334 - protein, 23 aa, Artificial Sequence
  Core polypeptide
TALLEQAQIQQEKNEYELQKLAK

SEQ ID NO: 1335 - protein, 23 aa, Artificial Sequence
  Core polypeptide
TALLEQAQIQQEKGEYELQKLAK

SEQ ID NO: 1336 - protein, 23 aa, Artificial Sequence
  Core polypeptide
TALLEQAQIQQEKAEYELQKLAE

SEQ ID NO: 1337 - protein, 23 aa, Artificial Sequence
  Core polypeptide
TALLEQAQIQQEKNEYELQKLAE

SEQ ID NO: 1338 - protein, 23 aa, Artificial Sequence
  Core polypeptide
TALLEQAQIQQEKGEYELQKLAE

SEQ ID NO: 1339 - protein, 28 aa, Artificial Sequence
  Core polypeptide
DEFDASISQVNEKINQSLAFIRKSDELL

SEQ ID NO: 1340 - protein, 27 aa, Artificial Sequence
  Core polypeptide
DEYDASISQVNEKINQALAYIREADEL

SEQ ID NO: 1341 - protein, 27 aa, Artificial Sequence
  Core polypeptide
DEYDASISQVNEEINQALAYIRKADEL

SEQ ID NO: 1342 - protein, 28 aa, Artificial Sequence
  Core polypeptide
DEFDESISQVNEKIEESLAFIRKSDELL

SEQ ID NO: 1343 - protein, 27 aa, Artificial Sequence
  Core polypeptide
DEFDESISQVNEKIEESLAFIRKSDEL

SEQ ID NO: 1344 - protein, 10 aa, Artificial Sequence
  Core polypeptide
QHWSYGLRPG

SEQ ID NO: 1345 - protein, 35 aa, Artificial Sequence
  Core polypeptide
GLSPTVWLSVIWMMWYWGPSLYSILSPFLPLLPIF

SEQ ID NO: 1346 - protein, 36 aa, Artificial Sequence
  Core polypeptide
VGLSPTVWLSVIWMMWYWWGPSLYSILSPFLPLLPI

SEQ ID NO: 1347 - protein, 35 aa, Artificial Sequence
  Core polypeptide
FVGLSPTVWLSVIWMMWYWGPSLYSILSPFLPLLP

SEQ ID NO: 1348 - protein, 35 aa, Artificial Sequence
  Core polypeptide
WFVGLSPTVWLSVIWMMWYWGPSLYSILSPFLPLL

SEQ ID NO: 1349 - protein, 35 aa, Artificial Sequence
  Core polypeptide
QWFVGLSPTVWLSVIWMMWYWGPSLYSILSPFLPL

SEQ ID NO: 1350 - protein, 35 aa, Artificial Sequence
  Core polypeptide
VQWFVGLSPTVWLSVIWMMWYWGPSLYSILSPFLP

SEQ ID NO: 1351 - protein, 35 aa, Artificial Sequence
  Core polypeptide
FVQWFVGLSPTVWLSVIWMMWYWGPSLYSILSPFL

SEQ ID NO: 1352 - protein, 35 aa, Artificial Sequence
  Core polypeptide
PFVQWFVGLSPTVWLSVIWMMWYWGPSLYSILSPF

SEQ ID NO: 1353 - protein, 35 aa, Artificial Sequence
  Core polypeptide
VPFVQWFVGLSPTVWLSVIWMMWYWGPSLYSILSP

SEQ ID NO: 1354 - protein, 35 aa, Artificial Sequence
  Core polypeptide
LVPFVQWFVGLSPTVWLSVIWMMWYWGPSLYSILS

SEQ ID NO: 1355 - protein, 35 aa, Artificial Sequence
  Core polypeptide
LQAGFFLLTRILTIPQSLDSWWTSLNFLGGTTVAL

SEQ ID NO: 1356 - protein, 36 aa, Artificial Sequence
  Core polypeptide
WNWFIHSLIEESQNQQEKNEQELLELDKWASLWNWF

SEQ ID NO: 1357 - protein, 36 aa, Artificial Sequence
  Core polypeptide
YTNTIYTLLEESQNQQEKNEQELLELDKWASLWNWF

SEQ ID NO: 1358 - protein, 36 aa, Artificial Sequence
  Core polypeptide
YTGIIYNLLEESQNQQEKNEQELLELDKWANLWNWF

SEQ ID NO: 1359 - protein, 36 aa, Artificial Sequence; identical to SEQ ID NO: 1358
  Core polypeptide

SEQ ID NO: 1360 - protein, 36 aa, Artificial Sequence
  Core polypeptide
YTSLIYSLLEKSQIQQEKNEQELLELDKWASLWNWF

SEQ ID NO: 1361 - protein, 36 aa, Artificial Sequence
  Core polypeptide
YTSLIYSLLEKSQIQQEKNEQELLQLDKWASLWNWF

SEQ ID NO: 1362 - protein, 21 aa, Artificial Sequence
  Core polypeptide
EKSQIQQEKNEQELLELDKWA

SEQ ID NO: 1363 - skipped
  Core polypeptide

SEQ ID NO: 1364 - protein, 21 aa, Artificial Sequence
  Core polypeptide
EQAQIQQEKNEYELQKLDKWA

SEQ ID NO: 1365 - protein, 21 aa, Artificial Sequence
  Core polypeptide
EQAQIQQEKNEYELQKLDKWA

SEQ ID NO: 1366 - protein, 36 aa, Artificial Sequence
  Core polypeptide
  SITE (3)...(3): Xaa=unknown amino acid
  SITE (10)...(10): Xaa=unknown amino acid
  SITE (17)...(17): Xaa=unknown amino acid
  SITE (24)...(24): Xaa=unknown amino acid
YTXLIHSLIXESQNQQXKNEQELXELDKWASLWNWF

SEQ ID NO: 1367 - protein, 27 aa, Artificial Sequence
  Core polypeptide
  SITE (3)...(3): Xaa=unknown amino acid
  SITE (10)...(10): Xaa=unknown amino acid
  SITE (17)...(17): Xaa=unknown amino acid
  SITE (24)...(24): Xaa=unknown amino acid
YTXLIHSLIXESQNQQXKNEQELXELD

SEQ ID NO: 1368 - protein, 27 aa, Artificial Sequence
  Core polypeptide
YTSLIHSLIEESQNQQEKNEQELLELD

SEQ ID NO: 1369 - protein, 39 aa, Artificial Sequence
  Core polypeptide
  SITE (6)...(6): Xaa=unknown amino acid
  SITE (13)...(13): Xaa=unknown amino acid
  SITE (20)...(20): Xaa=unknown amino acid
  SITE (27)...(27): Xaa=unknown amino acid
WQEWEXKITALLXQAQIQQXKNEYELXKLDKWASLWEWF

SEQ ID NO: 1370 - protein, 34 aa, Artificial Sequence
  Core polypeptide
  SITE (1)...(1): Xaa=unknown amino acid
  SITE (8)...(8): Xaa=unknown amino acid
  SITE (15)...(15): Xaa=unknown amino acid
  SITE (22)...(22): Xaa=unknown amino acid
XKITALLXQAQIQQXKNEYELXKLDKWASLWEWF

SEQ ID NO: 1371 - protein, 30 aa, Artificial Sequence
  Core polypeptide
  SITE (6)...(6): Xaa=unknown amino acid
  SITE (13)...(13): Xaa=unknown amino acid
  SITE (20)...(20): Xaa=unknown amino acid
  SITE (27)...(27): Xaa=unknown amino acid
WQEWEXKITALLXQAQIQQXKNEYELXKLD

SEQ ID NO: 1372 - protein, 27 aa, Artificial Sequence
  Core polypeptide
WEQKITALLEQAQIQQEKNEYELQKLD

SEQ ID NO: 1373 - protein, 25 aa, Artificial Sequence
  Core polypeptide
  SITE (3)...(3): Xaa=unknown amino acid
  SITE (10)...(10): Xaa=unknown amino acid
  SITE (15)...(15): Xaa=unknown amino acid
  SITE (22)...(22): Xaa=unknown amino acid
WEXKITALLXQAQQXKNEYELXKLD

SEQ ID NO: 1374 - protein, 25 aa, Artificial Sequence
  Core polypeptide
  SITE (1)...(1): Xaa=unknown amino acid
  SITE (8)...(8): Xaa=unknown amino acid
  SITE (15)...(15): Xaa=unknown amino acid
  SITE (22)...(22): Xaa=unknown amino acid
XKITALLXQAQIQQXKNEYELXKLD

SEQ ID NO: 1375 - protein, 25 aa, Artificial Sequence
  Core polypeptide
QKITALLEQAQIQQEKNEYELQKLD

SEQ ID NO: 1376 - protein, 32 aa, Artificial Sequence
  Core polypeptide
VYPSDEYDASISQVNEEINQALAYIRKADELL

SEQ ID NO: 1377 - protein, 25 aa, Artificial Sequence
  Core polypeptide
QKITALLEQAQIQQEKNEYELQKLD

SEQ ID NO: 1378 - protein, 31 aa, Artificial Sequence
  Core polypeptide
VYPSDEYDASISQVNEEINQALAYIRKADEL

SEQ ID NO: 1379 - protein, 30 aa, Artificial Sequence
  Core polypeptide
WQEWEQKITALLEQAQIQQEKNEYELQKLD

SEQ ID NO: 1380 - protein, 34 aa, Artificial Sequence
  Core polypeptide
VYPSDEYDASISQVNEEINQALAYIRKADELLEN

SEQ ID NO: 1381 - protein, 34 aa, Artificial Sequence
  Core polypeptide
QKITALLEQAQIQQEKNEYELQKLDKWASLWEWF

SEQ ID NO: 1382 - protein, 35 aa, Artificial Sequence
  Core polypeptide
STNKAVVSLSNGVSVLTSKVLDLKNYIDKQLLPIV

SEQ ID NO: 1383 - protein, 35 aa, Artificial Sequence
  Core polypeptide
TNKAVVSLSNGVSVLTSKVLDLKNYIDKQLLPIVN

SEQ ID NO: 1384 - protein, 35 aa, Artificial Sequence
  Core polypeptide
NKAVVSLSNGVSVLTSKVLDLKNYIDKQLLPIVNK

SEQ ID NO: 1385 - protein, 35 aa, Artificial Sequence
  Core polypeptide
KAVVSLSNGVSVLTSKVLDLKNYIDKQLLPIVNKQ

SEQ ID NO: 1386 - protein, 36 aa, Artificial Sequence
  Core polypeptide
AVVSLSNGVSVLTSKVLDLLKNYIDKQLLPIVNKQS

SEQ ID NO: 1387 - protein, 34 aa, Artificial Sequence
  Core polypeptide
VVSLSNGVSVLTSKVLDLKNYIDKQLLPIVNKQS

SEQ ID NO: 1388 - protein, 34 aa, Artificial Sequence
  Core polypeptide
VSLSNGVSVLTSKVLDLKNYIDKQLLPIVNKQSS

SEQ ID NO: 1389 - protein, 34 aa, Artificial Sequence
  Core polypeptide
SLSNGVSVLTSKVLDLKNYIDKQLLPIVNKQSSI

SEQ ID NO: 1390 - protein, 34 aa, Artificial Sequence
  Core polypeptide
LSNGVSVLTSKVLDLKNYIDKQLLPIVNKQSSIS

SEQ ID NO: 1391 - protein, 34 aa, Artificial Sequence
  Core polypeptide
SNGVSVLTSKVLDLKNYIDKQLLPIVNKQSSISN

SEQ ID NO: 1392 - protein, 34 aa, Artificial Sequence
  Core polypeptide
NGVSVLTSKVLDLKNYIDKQLLPIVNKQSSISNI

SEQ ID NO: 1393 - protein, 34 aa, Artificial Sequence
  Core polypeptide
GVSVLTSKVLDLKNYIDKQLLPIVNKQSSISNIE

SEQ ID NO: 1394 - protein, 34 aa, Artificial Sequence
  Core polypeptide
VSVLTSKVLDLKNYIDKQLLPIVNKQSSISNIET

SEQ ID NO: 1395 - protein, 34 aa, Artificial Sequence
  Core polypeptide
SVLTSKVLDLKNYIDKQLLPIVNKQSSISNIETV

SEQ ID NO: 1396 - protein, 34 aa, Artificial Sequence
  Core polypeptide
VLTSKVLDLKNYIDKQLLPIVNKQSSISNIETVI

SEQ ID NO: 1397 - protein, 33 aa, Artificial Sequence
  Core polypeptide
LTSKVLDKNYIDKQLLPIVNKQSSISNIETVIE

SEQ ID NO: 1398 - protein, 34 aa, Artificial Sequence
  Core polypeptide
TSKVLDLKNYIDKQLLPIVNKQSSISNIETVIEF

SEQ ID NO: 1399 - protein, 34 aa, Artificial Sequence
  Core polypeptide
SKVLDLKNYIDKQLLPIVNKQSSISNIETVIEFQ

SEQ ID NO: 1400 - protein, 34 aa, Artificial Sequence
  Core polypeptide
KVLDLKNYIDKQLLPIVNKQSSISNIETVIEFQQ

SEQ ID NO: 1401 - protein, 34 aa, Artificial Sequence
  Core polypeptide
VLDLKNYIDKQLLPIVNKQSSISNIETVIEFQQK

SEQ ID NO: 1402 - protein, 34 aa, Artificial Sequence
  Core polypeptide
LDLKNYIDKQLLPIVNKQSSISNIETVIEFQQKN

SEQ ID NO: 1403 - protein, 34 aa, Artificial Sequence
  Core polypeptide
DLKNYIDKQLLPIVNKQSSISNIETVIEFQQKNN

SEQ ID NO: 1404 - protein, 34 aa, Artificial Sequence
  Core polypeptide
LKNYIDKQLLPIVNKQSSISNIETVIEFQQKNNR

SEQ ID NO: 1405 - protein, 34 aa, Artificial Sequence
  Core polypeptide
KNYIDKQLLPIVNKQSSISNIETVIEFQQKNNRL

SEQ ID NO: 1406 - protein, 35 aa, Artificial Sequence
  Core polypeptide
NYIDKQLLPIVNKQSISISNIETVIEFQQKNNRLL

SEQ ID NO: 1407 - protein, 34 aa, Artificial Sequence
  Core polypeptide
YIDKQLLPIVNKQSSISNIETVIEFQQKNNRLLE

SEQ ID NO: 1408 - protein, 34 aa, Artificial Sequence
  Core polypeptide
IDKQLLPIVNKQSSISNIETVIEFQQKNNRLLEI

SEQ ID NO: 1409 - protein, 34 aa, Artificial Sequence
  Core polypeptide
DKQLLPIVNKQSSISNIETVIEFQQKNNRLLEIT

SEQ ID NO: 1410 - protein, 34 aa, Artificial Sequence
  Core polypeptide
KQLLPIVNKQSSISNIETVIEFQQKNNRLLEITR

SEQ ID NO: 1411 - protein, 34 aa, Artificial Sequence
  Core polypeptide
QLLPIVNKQSSISNIETVIEFQQKNNRLLEITRE

SEQ ID NO: 1412 - protein, 23 aa, Artificial Sequence
  Core polypeptide
VYPSDEYDASISQVNEEINQALA

SEQ ID NO: 1413 - protein, 23 aa, Artificial Sequence
  Core polypeptide
QVNEEINQALAYIRKADELLENV

SEQ ID NO: 1414 - protein, 35 aa, Artificial Sequence; identical to SEQ ID NO: 692
  Core polypeptide

SEQ ID NO: 1415 - protein, 27 aa, Artificial Sequence
  Core polypeptide
DEYDASISQVNEEINQALAYIREADEL

SEQ ID NO: 1416 - protein, 27 aa, Artificial Sequence
  Core polypeptide
DEYDASISQVNEKINQALAYIREADEL

SEQ ID NO: 1417 - protein, 35 aa, Artificial Sequence; identical to SEQ ID NO: 1240
  Core polypeptide

SEQ ID NO: 1418 - protein, 34 aa, Artificial Sequence
  Core polypeptide
DDELNSVKNGTYDFPKFEEESKLNRNEIKGVKLS

SEQ ID NO: 1419 - protein, 39 aa, Artificial Sequence
  Core polypeptide
YHKCDDECLNSVKNGTFDFPKFEEESKLNREIKGVKLSS

SEQ ID NO: 1420 - protein, 38 aa, Artificial Sequence
  Core polypeptide
YHKDDELNSVKNGTFDFPKFEEESKLNRNEIKGVKLSS

SEQ ID NO: 1421 - protein, 36 aa, Artificial Sequence; identical to SEQ ID NO: 1246
  Core polypeptide

SEQ ID NO: 1422 - protein, 36 aa, Artificial Sequence; identical to SEQ ID NO: 1247
  Core polypeptide

SEQ ID NO: 1423 - protein, 36 aa, Artificial Sequence; identical to SEQ ID NO: 1248
  Core polypeptide

SEQ ID NO: 1424 - protein, 36 aa, Artificial Sequence; identical to SEQ ID NO: 1249
  Core polypeptide

SEQ ID NO: 1425 - protein, 36 aa, Artificial Sequence; identical to SEQ ID NO: 1250
  Core polypeptide

SEQ ID NO: 1426 - protein, 36 aa, Artificial Sequence; identical to SEQ ID NO: 1251
  Core polypeptide

SEQ ID NO: 1427 - protein, 35 aa, Artificial Sequence
  Core polypeptide
YTSLIHSLIEESQIQQEKNEYELQKLDWASLWEWF

SEQ ID NO: 1428 - protein, 36 aa, Artificial Sequence; identical to SEQ ID NO: 1253
  Core polypeptide

SEQ ID NO: 1429 - protein, 36 aa, Artificial Sequence; identical to SEQ ID NO: 1254
  Core polypeptide

SEQ ID NO: 1430 - protein, 36 aa, Artificial Sequence; identical to SEQ ID NO: 1255
  Core polypeptide

SEQ ID NO: 1431 - protein, 35 aa, Artificial Sequence
  Core polypeptide
WQEWEQKITALLEQAQIQQEKNEYELQKLDKWEWF

SEQ ID NO: 1432 - protein, 39 aa, Artificial Sequence
  Core polypeptide
WQEWEQKITALLEQAQIQQEKNEYELQKLIEWASLWEWF

SEQ ID NO: 1433 - protein, 8 aa, Artificial Sequence
  Core polypeptide
WASLWEWF

SEQ ID NO: 1434 - protein, 35 aa, Artificial Sequence; identical to SEQ ID NO: 1122
  Core polypeptide

SEQ ID NO: 1435 - protein, 35 aa, Artificial Sequence; identical to SEQ ID NO: 1123
  Core polypeptide

SEQ ID NO: 1436 - protein, 31 aa, Artificial Sequence
  Core polypeptide
WQAWDEYDASISDVNEKINQALAYIREADEL

SEQ ID NO: 1437 - skipped

SEQ ID NO: 1438 - protein, 40 aa, Artificial sequence
  Core polypeptide
GWQEWEQRITALLEQAQIQQERNEYELQRLDEWASLWEWF

SEQ ID NO: 1439 - protein, 40 aa, Artificial sequence; identical to SEQ ID NO: 1438
  Core polypeptide

SEQ ID NO: 1440 - protein, 36 aa, Artificial sequence
  Core polypeptide
YTSLITALLEQAQIQQERNEQELLELDEWASLWEWF

SEQ ID NO: 1441 - protein, 36 aa, Artificial sequence; identical to SEQ ID NO: 1440
  Core polypeptide

SEQ ID NO: 1442 - protein, 40 aa, Artificial sequence
  Core polypeptide
GWQEWEQRITALLEQAQIQQERNEYELQELDEWASLWEWF

SEQ ID NO: 1443 - protein, 40 aa, Artificial sequence; identical to SEQ ID NO: 1442
  Core polypeptide

SEQ ID NO: 1444 - protein, 36 aa, Artificial sequence; identical to SEQ ID NO: 1223
  Core polypeptide

SEQ ID NO: 1445 - protein, 40 aa, Artificial sequence
  Core polypeptide
GWQEWEQRITALLEQAQIQQERNEYELQRLDRWASLWEWF

SEQ ID NO: 1446 - protein, 40 aa, Artificial sequence; identical to SEQ ID NO: 1445
  Core polypeptide

SEQ ID NO: 1447 - protein, 40 aa, Artificial sequence
  Core polypeptide
GWQEWEQRITALLEQAQIQQERNEYELQELDRWASLWEWF

SEQ ID NO: 1448 - protein, 40 aa, Artificial sequence; identical to SEQ ID NO: 1447
  Core polypeptide

SEQ ID NO: 1449 - protein, 36 aa, Artificial sequence
  Core polypeptide
YTSLIGSLIEESQNQQERNEQELLELDRWASLWNWF

SEQ ID NO: 1450 - protein, 36 aa, Artificial sequence; identical to SEQ ID NO: 1449
  Core polypeptide

SEQ ID NO: 1451 - protein, 18 aa, Artificial sequence
  Core polypeptide
YTSLIHSLIEESQNQQEK

SEQ ID NO: 1452 - protein, 18 aa, Artificial sequence
  Core polypeptide
NEQELLELDKWASLWNWF

SEQ ID NO: 1453 - protein, 39 aa, Artificial sequence
  Core polypeptide
AAAWEQKITALLEQAQIQQEKNEYELQKLDKWASLWEWF

SEQ ID NO: 1454 - protein, 39 aa, Artificial sequence
  Core polypeptide
WQEAAAKITALLEQAQIQQEKNEYELQKLDKWASLWEWF

SEQ ID NO: 1455 - protein, 39 aa, Artificial sequence
  Core polypeptide
WQEWEQAAAALLEQAQIQQEKNEYELQKLDKWASLWEWF

SEQ ID NO: 1456 - protein, 39 aa, Artificial sequence
  Core polypeptide
WQEWEQKITAAAEQAQIQQEKNEYELQKLDKWASLWEWF

SEQ ID NO: 1457 - protein, 39 aa, Artificial sequence
  Core polypeptide
WQEWEQKITALLAAAQIQQEKNEYELQKLDKWASLWEWF

SEQ ID NO: 1458 - protein, 39 aa, Artificial sequence
  Core polypeptide
WQEWEQKITALLEQAAAAQEKNEYELQKLDKWASLWEWF

SEQ ID NO: 1459 - protein, 39 aa, Artificial sequence
  Core polypeptide
WQEWEQKITALLEQAQIQAAANEYELQKLDKWASLWEWF

SEQ ID NO: 1460 - protein, 39 aa, Artificial sequence
  Core polypeptide
WQEWEQKITALLEQAQIQQEKAAAELQKLDKWASLWEWF

SEQ ID NO: 1461 - protein, 39 aa, Artificial sequence
  Core polypeptide
WQEWEQKITALLEQAQIQQEKNEYAAAKLDKWASLWEWF

SEQ ID NO: 1462 - protein, 39 aa, Artificial sequence
  Core polypeptide
WQEWEQKITALLEQAQIQQEKNEYELQAAAKWASLWEWF

SEQ ID NO: 1463 - protein, 39 aa, Artificial sequence
  Core polypeptide
WQEWEQKITALLEQAQIQQEKNEYELQKLDAAASLWEWF

SEQ ID NO: 1464 - protein, 39 aa, Artificial sequence
  Core polypeptide
WQEWEQKITALLEQAQIQQEKNEYELQKLDKWAAAAEWF

SEQ ID NO: 1465 - protein, 39 aa, Artificial sequence
  Core polypeptide
WQEWEQKITALLEQAQIQQEKNEYELQKLDKWASLWAAA

SEQ ID NO: 1466 - protein, 35 aa, Artificial sequence
  Core polypeptide
YTSLIHSLIEESQNQQEKNEQELLLDKWASLWNWF

SEQ ID NO: 1467 - protein, 35 aa, Artificial sequence
  Core polypeptide
YTSLIHSLIEESQNQEKNEQELLELDKWASLWNWF

SEQ ID NO: 1468 - protein, 9 aa, Artificial sequence
  Core polypeptide
ERTLDFHDS

SEQ ID NO: 1469 - protein, 36 aa, Artificial sequence; identical to SEQ ID NO: 15
  Core polypeptide

SEQ ID NO: 1470 - protein, 36 aa, Artificial sequence; identical to SEQ ID NO: 15
  Core polypeptide

SEQ ID NO: 1471 - protein, 26 aa, Artificial sequence
  Core polypeptide
YTSLIHSLIEESQNQQDKWASLWNWF

SEQ ID NO: 1472 - protein, 35 aa, Artificial sequence
  Core polypeptide
FYEIIMDIEQNNVQGKKGIQQLQKWEDWVGWIGNI

SEQ ID NO: 1473 - protein, 35 aa, Artificial sequence
  Core polypeptide
INQTIWNHGNITLGEWYNQTKDLQQKFYEIIMDIE

SEQ ID NO: 1474 - protein, 35 aa, Artificial sequence
  Core polypeptide
WNHGNITLGEWYNQTKDLQQKFYEIIMDIEQNNVQ

SEQ ID NO: 1475 - protein, 36 aa, Artificial sequence
  Core polypeptide
YTSLIHSLIEESENQQEKNEQELLELDKWASLWNWF

SEQ ID NO: 1476 - protein, 36 aa, Artificial sequence; identical to SEQ ID NO: 729
  Core polypeptide

SEQ ID NO: 1477 - protein, 36 aa, Artificial sequence
  Core polypeptide
YTSLIHSLIEESQNEQEKNEQELLELDKWASLWNWF

SEQ ID NO: 1478 - protein, 36 aa, Artificial sequence
  Core polypeptide
YTSLIHSLIEESQNQEEKNEQELLELDKWASLWNWF

SEQ ID NO: 1479 - protein, 36 aa, Artificial sequence; identical to SEQ ID NO: 728
  Core polypeptide

SEQ ID NO: 1480 - protein, 35 aa, Artificial sequence
  Core polypeptide
LGEWYNQTKDLQQKFYEIIMDIEQNNVQGKKGIQQ

SEQ ID NO: 1481 - protein, 35 aa, Artificial sequence
  Core polypeptide
WYNQTKDLQQKFYEIIMDIEQNNVQGKKGIQQLQK

SEQ ID NO: 1482 - protein, 36 aa, Artificial sequence
  Core polypeptide
YTSLIHSLIEESQNQQEKNEEELLELDKWASLWNWF

SEQ ID NO: 1483 - protein, 36 aa, Artificial sequence; identical to SEQ ID NO: 731
  Core polypeptide

SEQ ID NO: 1484 - protein, 36 aa, Artificial sequence
  Core polypeptide
  SITE (1)...(1): Xaa=unknown amino acid
  SITE (36)...(36): Xaa=unknown amino acid
XTSLIHSLIEESQNQQEKNEQELLELDKWASLWNWX

SEQ ID NO: 1485 - protein, 35 aa, Artificial sequence
  Core polypeptide
YNQTKDLQQKFYEIIMDIEQNNVQGKKGIQQLQKW

SEQ ID NO: 1486 - protein, 36 aa, Artificial sequence; identical to SEQ ID NO: 15
  Core polypeptide

SEQ ID NO: 1487 - protein, 44 aa, Artificial sequence
  Core polypeptide
TLTVQARQLLSGIVQQQNNLLRAIEAQQHLLQLTVWGIKQLQAR

SEQ ID NO: 1488 - protein, 35 aa, Artificial sequence
  Core polypeptide
LQQKFYEIIMDIEQNNVQGKKGIQQLQKWEDWVGW

SEQ ID NO: 1489 - protein, 36 aa, Artificial sequence
  Core polypeptide
YTSLIHSLIEESQNQQEKNEQELLALDKWASLWNWF

SEQ ID NO: 1490 - protein, 36 aa, Artificial sequence
  Core polypeptide
YTSLIHSLIEESQNQQEKNEQELLEADKWASLWNWF

SEQ ID NO: 1491 - protein, 36 aa, Artificial sequence
  Core polypeptide
YTSLIHSLIEESQNQQEKNEQELLELAKWASLWNWF

SEQ ID NO: 1492 - protein, 36 aa, Artificial sequence
  Core polypeptide
YTSLIHSLIEESQNQQEKAEQELLELDKWASLWNWF

SEQ ID NO: 1493 - protein, 36 aa, Artificial sequence
  Core polypeptide
YTSLIHSLIEESQNQQEKNAQELLELDKWASLWNWF

SEQ ID NO: 1494 - protein, 36 aa, Artificial sequence
  Core polypeptide
YTSLIHSLIEESQNQQEKNEAELLELDKWASLWNWF

SEQ ID NO: 1495 - protein, 39 aa, Artificial sequence
  Core polypeptide
WQEWEQKITALLEQAQIQQEKNEQELQKLDKWASLWEWF

SEQ ID NO: 1496 - protein, 39 aa, Artificial sequence
  Core polypeptide
WQEWEQKITALLEQAQIQQEKAEYELQKLDKWASLWEWF

SEQ ID NO: 1497 - protein, 39 aa, Artificial sequence
  Core polypeptide
WQEWEQKITALLEQAQIQQEKNAYELQKLDKWASLWEWF

SEQ ID NO: 1498 - protein, 39 aa, Artificial sequence
  Core polypeptide
WQEWEQKITALLEQAQIQQEKNEAELQKLDKWASLWEWF

SEQ ID NO: 1499 - protein, 9 aa, Artificial sequence
  Core polypeptide
EYDLRRWEK

SEQ ID NO: 1500 - protein, 9 aa, Artificial sequence
  Core polypeptide
EQELLELDK

SEQ ID NO: 1501 - protein, 9 aa, Artificial sequence
  Core polypeptide
EYELQKLDK

SEQ ID NO: 1502 - protein, 39 aa, Artificial sequence
  Core polypeptide
WQEWEQKITALLEQAQIQQEKNEQELLKLDKWASLWEWF

SEQ ID NO: 1503 - protein, 39 aa, Artificial sequence
  Core polypeptide
WQEWEQKITALLEQAQIQQEKNEQELLELDKWASLWEWF

SEQ ID NO: 1504 - protein, 32 aa, Artificial sequence
  Core polypeptide
WQEWEQKITALLEQAQIQQEKNDKWASLWEWF

SEQ ID NO: 1505 - protein, 36 aa, Artificial sequence
  Core polypeptide
YTSLIHSLIEESQNQAEKNEQELLELDKWASLWNWF

SEQ ID NO: 1506 - protein, 36 aa, Artificial sequence
  Core polypeptide
YTSLIHSLIEESQNQQAKNEQELLELDKWASLWNWF

SEQ ID NO: 1507 - protein, 36 aa, Artificial sequence
  Core polypeptide
YTSLIHSLIEESQNQQEANEQELLELDKWASLWNWF

SEQ ID NO: 1508 - protein, 36 aa, Artificial sequence
  Core polypeptide
YTSLIHSLIEESANQQEANEQELLELDKWASLWNWF

SEQ ID NO: 1509 - protein, 38 aa, Artificial sequence
  Core polypeptide
YTSLIHSLIEESQAQQEKNEQELLELDKWASLWNWFNH

SEQ ID NO: 1510 - protein, 36 aa, Artificial sequence
  Core polypeptide
YTSLIHSLIEESQNAQEKNEQELLELDKWASLWNWF

SEQ ID NO: 1511 - protein, 36 aa, Artificial sequence
  Core polypeptide
YTSLIHALIEESQNQQEKNEQELLELDKWASLWNWF

SEQ ID NO: 1512 - protein, 36 aa, Artificial sequence
  Core polypeptide
YTSLIHSAIEESQNQQEKNEQELLELDKWASLWNWF

SEQ ID NO: 1513 - protein, 35 aa, Artificial sequence; identical to SEQ ID NO: 692
  Core polypeptide

SEQ ID NO: 1514 - protein, 36 aa, Artificial sequence
  Core polypeptide
YTSLIHSLAEESQNQQEKNEQELLELDKWASLWNWF

SEQ ID NO: 1515 - protein, 36 aa, Artificial sequence
  Core polypeptide
YTSAIHSLIEESQNQQEKNEQELLELDKWASLWNWF

SEQ ID NO: 1516 - protein, 36 aa, Artificial sequence
  Core polypeptide
YTSLAHSLIEESQNQQEKNEQELLELDKWASLWNWF

SEQ ID NO: 1517 - protein, 36 aa, Artificial sequence
  Core polypeptide
YTSLIASLIEESQNQQEKNEQELLELDKWASLWNWF

SEQ ID NO: 1518 - protein, 36 aa, Artificial sequence
  Core polypeptide
ATSLIHSLIEESQNQQEKNEQELLELDKWASLWNWF

SEQ ID NO: 1519 - protein, 36 aa, Artificial sequence
  Core polypeptide
YASLIHSLIEESQNQQEKNEQELLELDKWASLWNWF

SEQ ID NO: 1520 - protein, 36 aa, Artificial sequence
  Core polypeptide
YTALIHSLIEESQNQQEKNEQELLELDKWASLWNWF

SEQ ID NO: 1521 - protein, 30 aa, Artificial sequence
  Core polypeptide
RIQDLEKYVEDTKIDLWSYNAELLVALENQ

SEQ ID NO: 1522 - protein, 24 aa, Artificial sequence
  Core polypeptide
HTIDLTDSEMNKLFEKTRRQLREN

SEQ ID NO: 1523 - protein, 17 aa, Artificial sequence
  Core polypeptide
SEMNKLFEKTRRQLREN

SEQ ID NO: 1524 - protein, 35 aa, Artificial sequence
  Core polypeptide
VFPSDEADASISQVNEKINQSLAFIRKSDELLHNV

SEQ ID NO: 1525 - protein, 35 aa, Artificial sequence
  Core polypeptide
VFPSDEFAASISQVNEKINQSLAFIRKSDELLHNV

SEQ ID NO: 1526 - protein, 35 aa, Artificial sequence
  Core polypeptide
VFPSDEFDASISAVNEKINQSLAFIRKSDELLHNV

SEQ ID NO: 1527 - protein, 35 aa, Artificial sequence
  Core polypeptide
VFPSDEFDASISQANEKINQSLAFIRKSDELLHNV

SEQ ID NO: 1528 - protein, 35 aa, Artificial sequence
  Core polypeptide
VFPSDEFDASISQVAEKINQSLAFIRKSDELLHNV

SEQ ID NO: 1529 - protein, 39 aa, Artificial sequence
  Core polypeptide
WQEWEQKITAALEQAQIQQEKNEYELQKLDKWASLWEWF

SEQ ID NO: 1530 - protein, 39 aa, Artificial sequence
  Core polypeptide
WQEWEQKITALAEQAQIQQEKNEYELQKLDKWASLWEWF

SEQ ID NO: 1531 - protein, 39 aa, Artificial sequence
  Core polypeptide
WQEWEQKITALLEQAAIQQEKNEYELQKLDKWASLWEWF

SEQ ID NO: 1532 - protein, 39 aa, Artificial sequence
  Core polypeptide
WQEWEQKITALLEQAQAQQEKNEYELQKLDKWASLWEWF

SEQ ID NO: 1533 - protein, 39 aa, Artificial sequence
  Core polypeptide
WQEWEQKITALLEQAQIAQEKNEYELQKLDKWASLWEWF

SEQ ID NO: 1534 - protein, 39 aa, Artificial sequence
  Core polypeptide
WQEWEQKITALLEQAQIQAEKNEYELQKLDKWASLWEWF

SEQ ID NO: 1535 - protein, 35 aa, Artificial sequence
  Core polypeptide
VFPSDEFDASISQVNEKINQSAAFIRKSDELLHNV

SEQ ID NO: 1536 - protein, 35 aa, Artificial sequence
  Core polypeptide
VFPSDEFDASISQVNEKINQSLAAIRKSDELLHNV

SEQ ID NO: 1537 - protein, 35 aa, Artificial sequence
  Core polypeptide
VFPSDEFDASISQVNEKINQSLAFIRKSDEALHNV

SEQ ID NO: 1538 - protein, 35 aa, Artificial sequence
  Core polypeptide
VFPSDEFDASISQVNEKINQSLAFIRKSDELAHNV

SEQ ID NO: 1539 - protein, 35 aa, Artificial sequence
  Core polypeptide
VFPSDEFDASISQVNEKINQSLAFIRKSDELLANV

SEQ ID NO: 1540 - protein, 39 aa, Artificial sequence
  Core polypeptide
WQEWEQKITALLEQAQIQQAKNEYELQKLDKWASLWEWF

SEQ ID NO: 1541 - protein, 39 aa, Artificial sequence
  Core polypeptide
WQEWEQKITALLEQAQIQQEKNEYELQALDKWASLWEWF

SEQ ID NO: 1542 - protein, 39 aa, Artificial sequence
  Core polypeptide
WQEWEQKITALLEQAQIQQEKNEYELQKADKWASLWEWF

SEQ ID NO: 1543 - protein, 35 aa, Artificial Sequence; identical to SEQ ID NO: 124
  Core polypeptide

SEQ ID NO: 1544 - protein, 46 aa, Artificial Sequence
  Core polypeptide
VLHLEGEVNKIKSALLSTNKAVVSLSNGVSVLTSKVLDLKNYIDKQ

SEQ ID NO: 1545 - protein, 45 aa, Artificial Sequence
  Core polypeptide
VLHLEGEVNKIKSALLSTNKAVVSLSNGVSVLTSKVLDLKNYIDK

SEQ ID NO: 1546 - protein, 48 aa, Artificial Sequence
  Core polypeptide
SKVLHLEGEVNKIKSALLSTNKAVVSLSNGVSVLTSKVLDLKNYIDKQ

SEQ ID NO: 1547 - protein, 51 aa, Artificial Sequence
  Core polypeptide
AVSKVLHLEGEVNKIKSALLSTNKAVVSLSNGVSVLTSKVLDLKNYIDKQL

SEQ ID NO: 1548 - protein, 44 aa, Artificial Sequence
  Core polypeptide
VLHLEGEVNKIKSALLSTNKAVVSLSNGVSVLTSKVLDLKNYID

SEQ ID NO: 1549 - protein, 43 aa, Artificial Sequence
  Core polypeptide
VLHLEGEVNKIKSALLSTNKAVVSLSNGVSVLTSKVLDLKNYI

SEQ ID NO: 1550 - protein, 54 aa, Artificial Sequence
  Core polypeptide
SGVAVSKVLHLEGEVNKIKSALLSTNKAVVSLSNGVSVLTSKVLDLKNYIDKQL

SEQ ID NO: 1551 - protein, 50 aa, Artificial Sequence
  Core polypeptide
AVSKVLHLEGEVNKIKSALLSTNKAVVSLSNGVSVLTSKVLDLKNYIDKQ

SEQ ID NO: 1552 - protein, 17 aa, Artificial Sequence
  Core polypeptide
LQARILAVERYLKDQQQ

SEQ ID NO: 1553 - protein, 36 aa, Artificial Sequence
  Core polypeptide
YTSLIYSLLEKSQTQQEKNEQELLELDKWASLWNWF

SEQ ID NO: 1554 - protein, 36 aa, Artificial Sequence
  Core polypeptide
LEANISKSLEQAQIQQEKNMYELQKLNSWDIFGNWF

SEQ ID NO: 1555 - protein, 36 aa, Artificial Sequence; identical to SEQ ID NO: 621
  Core polypeptide

SEQ ID NO: 1556 - protein, 3 aa, Artificial Sequence
  Core polypeptide
LEA

SEQ ID NO: 1557 - protein, 4 aa, Artificial Sequence
  Core polypeptide
LEAN

SEQ ID NO: 1558 - protein, 5 aa, Artificial Sequence
  Core polypeptide
LEANI

SEQ ID NO: 1559 - protein, 6 aa, Artificial Sequence
  Core polypeptide
LEANIS

SEQ ID NO: 1560 - protein, 7 aa, Artificial Sequence
  Core polypeptide
LEANISQ

SEQ ID NO: 1561 - protein, 8 aa, Artificial Sequence
  Core polypeptide
LEANISQS

SEQ ID NO: 1562 - protein, 9 aa, Artificial Sequence
  Core polypeptide
LEANISQSL

SEQ ID NO: 1563 - protein, 10 aa, Artificial Sequence
  Core polypeptide
LEANISQSLE

SEQ ID NO: 1564 - protein, 11 aa, Artificial Sequence
  Core polypeptide
LEANISQSLEQ

SEQ ID NO: 1565 - protein, 12 aa, Artificial Sequence
  Core polypeptide
LEANISQSLEQA

SEQ ID NO: 1566 - protein, 13 aa, Artificial Sequence
  Core polypeptide
LEANISQSLEQAQ

SEQ ID NO: 1567 - protein, 14 aa, Artificial Sequence
  Core polypeptide
LEANISQSLEQAQI

SEQ ID NO: 1568 - protein, 15 aa, Artificial Sequence
  Core polypeptide
LEANISQSLEQAQIQ

SEQ ID NO: 1569 - protein, 16 aa, Artificial Sequence
  Core polypeptide
LEANISQSLEQAQIQQ

SEQ ID NO: 1570 - protein, 17 aa, Artificial Sequence
  Core polypeptide
LEANISQSLEQAQIQQE

SEQ ID NO: 1571 - protein, 18 aa, Artificial Sequence
  Core polypeptide
LEANISQSLEQAQIQQEK

SEQ ID NO: 1572 - protein, 19 aa, Artificial Sequence
  Core polypeptide
LEANISQSLEQAQIQQEKN

SEQ ID NO: 1573 - protein, 20 aa, Artificial Sequence
  Core polypeptide
LEANISQSLEQAQIQQEKNM

SEQ ID NO: 1574 - protein, 21 aa, Artificial Sequence
  Core polypeptide
LEANISQSLEQAQIQQEKNMY

SEQ ID NO: 1575 - protein, 22 aa, Artificial Sequence
  Core polypeptide
LEANISQSLEQAQIQQEKNMYE

SEQ ID NO: 1576 - protein, 23 aa, Artificial Sequence
  Core polypeptide
LEANISQSLEQAQIQQEKNMYEL

SEQ ID NO: 1577 - protein, 24 aa, Artificial Sequence
  Core polypeptide
LEANISQSLEQAQIQQEKNMYELQ

SEQ ID NO: 1578 - protein, 25 aa, Artificial Sequence
  Core polypeptide
LEANISQSLEQAQIQQEKNMYELQK

SEQ ID NO: 1579 - protein, 26 aa, Artificial Sequence
  Core polypeptide
LEANISQSLEQAQIQQEKNMYELQKL

SEQ ID NO: 1580 - protein, 27 aa, Artificial Sequence
  Core polypeptide
LEANISQSLEQAQIQQEKNMYELQKLN

SEQ ID NO: 1581 - protein, 28 aa, Artificial Sequence
  Core polypeptide
LEANISQSLEQAQIQQEKNMYELQKLNS

SEQ ID NO: 1582 - protein, 29 aa, Artificial Sequence
  Core polypeptide
LEANISQSLEQAQIQQEKNMYELQKLNSW

SEQ ID NO: 1583 - protein, 30 aa, Artificial Sequence
  Core polypeptide
LEANISQSLEQAQIQQEKNMYELQKLNSWD

SEQ ID NO: 1584 - protein, 31 aa, Artificial Sequence
  Core polypeptide
LEANISQSLEQAQIQQEKNMYELQKLNSWDV

SEQ ID NO: 1585 - protein, 32 aa, Artificial Sequence
  Core polypeptide
LEANISQSLEQAQIQQEKNMYELQKLNSWDVF

SEQ ID NO: 1586 - protein, 33 aa, Artificial Sequence
  Core polypeptide
LEANISQSLEQAQIQQEKNMYELQKLNSWDVFT

SEQ ID NO: 1587 - protein, 34 aa, Artificial Sequence
  Core polypeptide
LEANISQSLEQAQIQQEKNMYELQKLNSWDVFTN

SEQ ID NO: 1588 - protein, 35 aa, Artificial Sequence
  Core polypeptide
LEANISQSLEQAQIQQEKNMYELQKLNSWDVFTNW

SEQ ID NO: 1589 - protein, 3 aa, Artificial Sequence
  Core polypeptide
NWL

SEQ ID NO: 1590 - protein, 4 aa, Artificial Sequence
  Core polypeptide
TNWL

SEQ ID NO: 1591 - protein, 5 aa, Artificial Sequence
  Core polypeptide
FTNWL

SEQ ID NO: 1592 - protein, 6 aa, Artificial Sequence
  Core polypeptide
VFTNWL

SEQ ID NO: 1593 - protein, 7 aa, Artificial Sequence
  Core polypeptide
DVFTNWL

SEQ ID NO: 1594 - protein, 8 aa, Artificial Sequence
  Core polypeptide
WDVFTNWL

SEQ ID NO: 1595 - protein, 9 aa, Artificial Sequence
  Core polypeptide
SWDVFTNWL

SEQ ID NO: 1596 - protein, 10 aa, Artificial Sequence
  Core polypeptide
NSWDVFTNWL

SEQ ID NO: 1597 - protein, 11 aa, Artificial Sequence
  Core polypeptide
LNSWDVFTNWL

SEQ ID NO: 1598 - protein, 12 aa, Artificial Sequence
  Core polypeptide
KLNSWDVFTNWL

SEQ ID NO: 1599 - protein, 13 aa, Artificial Sequence
  Core polypeptide
QKLNSWDVFTNWL

SEQ ID NO: 1600 - protein, 14 aa, Artificial Sequence
  Core polypeptide
LQKLNSWDVFTNWL

SEQ ID NO: 1601 - protein, 15 aa, Artificial Sequence
  Core polypeptide
ELQKLNSWDVFTNWL

SEQ ID NO: 1602 - protein, 16 aa, Artificial Sequence
  Core polypeptide
YELQKLNSWDVFTNWL

SEQ ID NO: 1603 - protein, 17 aa, Artificial Sequence
  Core polypeptide
MYELQKLNSWDVFTNWL

SEQ ID NO: 1604 - protein, 18 aa, Artificial Sequence
  Core polypeptide
NMYELQKLNSWDVFTNWL

SEQ ID NO: 1605 - protein, 19 aa, Artificial Sequence
  Core polypeptide
KNMYELQKLNSWDVFTNWL

SEQ ID NO: 1606 - protein, 20 aa, Artificial Sequence
  Core polypeptide
EKNMYELQKLNSWDVFTNWL

SEQ ID NO: 1607 - protein, 21 aa, Artificial Sequence
  Core polypeptide
QEKNMYELQKLNSWDVFTNWL

SEQ ID NO: 1608 - protein, 22 aa, Artificial Sequence
  Core polypeptide
QQEKNMYELQKLNSWDVFTNWL

SEQ ID NO: 1609 - protein, 23 aa, Artificial Sequence
  Core polypeptide
IQQEKNMYELQKLNSWDVFTNWL

SEQ ID NO: 1610 - protein, 24 aa, Artificial Sequence
  Core polypeptide
QIQQEKNMYELQKLNSWDVFTNWL

SEQ ID NO: 1611 - protein, 25 aa, Artificial Sequence
  Core polypeptide
AQIQQEKNMYELQKLNSWDVFTNWL

SEQ ID NO: 1612 - protein, 26 aa, Artificial Sequence
  Core polypeptide
QAQIQQEKNMYELQKLNSWDVFTNWL

SEQ ID NO: 1613 - protein, 27 aa, Artificial Sequence
  Core polypeptide
EQAQIQQEKNMYELQKLNSWDVFTNWL

SEQ ID NO: 1614 - protein, 28 aa, Artificial Sequence
  Core polypeptide
LEQAQIQQEKNMYELQKLNSWDVFTNWL

SEQ ID NO: 1615 - protein, 29 aa, Artificial Sequence
  Core polypeptide
SLEQAQIQQEKNMYELQKLNSWDVFTNWL

SEQ ID NO: 1616 - protein, 30 aa, Artificial Sequence
  Core polypeptide
QSLEQAQIQQEKNMYELQKLNSWDVFTNWL

SEQ ID NO: 1617 - protein, 31 aa, Artificial Sequence
  Core polypeptide
SQSLEQAQIQQEKNMYELQKLNSWDVFTNWL

SEQ ID NO: 1618 - protein, 32 aa, Artificial Sequence
  Core polypeptide
ISQSLEQAQIQQEKNMYELQKLNSWDVFTNWL

SEQ ID NO: 1619 - protein, 33 aa, Artificial Sequence
  Core polypeptide
NISQSLEQAQIQQEKNMYELQKLNSWDVFTNWL

SEQ ID NO: 1620 - protein, 34 aa, Artificial Sequence
  Core polypeptide
ANISQSLEQAQIQQEKNMYELQKLNSWDVFTNWL

SEQ ID NO: 1621 - protein, 35 aa, Artificial Sequence
  Core polypeptide
EANISQSLEQAQIQQEKNMYELQKLNSWDVFTNWL

SEQ ID NO: 1622 - protein, 3 aa, Artificial Sequence
  Core polypeptide
YTS

SEQ ID NO: 1623 - protein, 4 aa, Artificial Sequence
  Core polypeptide
YTSL

SEQ ID NO: 1624 - protein, 5 aa, Artificial Sequence
  Core polypeptide
YTSLI

SEQ ID NO: 1625 - protein, 6 aa, Artificial Sequence
  Core polypeptide
YTSLIH

SEQ ID NO: 1626 - protein, 7 aa, Artificial Sequence
  Core polypeptide
YTSLIHS

SEQ ID NO: 1627 - protein, 8 aa, Artificial Sequence
  Core polypeptide
YTSLIHSL

SEQ ID NO: 1628 - protein, 9 aa, Artificial Sequence
  Core polypeptide
YTSLIHSLI

SEQ ID NO: 1629 - protein, 10 aa, Artificial Sequence
  Core polypeptide
YTSLIHSLIE

SEQ ID NO: 1630 - protein, 11 aa, Artificial Sequence
  Core polypeptide
YTSLIHSLIEE

SEQ ID NO: 1631 - protein, 12 aa, Artificial Sequence
  Core polypeptide
YTSLIHSLIEES

SEQ ID NO: 1632 - protein, 13 aa, Artificial Sequence
  Core polypeptide
YTSLIHSLIEESQ

SEQ ID NO: 1633 - protein, 14 aa, Artificial Sequence
  Core polypeptide
YTSLIHSLIEESQN

SEQ ID NO: 1634 - protein, 15 aa, Artificial Sequence
  Core polypeptide
YTSLIHSLIEESQNQ

SEQ ID NO: 1635 - protein, 16 aa, Artificial Sequence
  Core polypeptide
YTSLIHSLIEESQNQQ

SEQ ID NO: 1636 - protein, 17 aa, Artificial Sequence
  Core polypeptide
YTSLIHSLIEESQNQQE

SEQ ID NO: 1637 - protein, 18 aa, Artificial Sequence
  Core polypeptide
YTSLIHSLIEESQNQQEK

SEQ ID NO: 1638 - protein, 19 aa, Artificial Sequence
  Core polypeptide
YTSLIHSLIEESQNQQEKN

SEQ ID NO: 1639 - protein, 20 aa, Artificial Sequence
  Core polypeptide
YTSLIHSLIEESQNQQEKNE

SEQ ID NO: 1640 - protein, 21 aa, Artificial Sequence
  Core polypeptide
YTSLIHSLIEESQNQQEKNEQ

SEQ ID NO: 1641 - protein, 22 aa, Artificial Sequence
  Core polypeptide
YTSLIHSLIEESQNQQEKNEQE

SEQ ID NO: 1642 - protein, 23 aa, Artificial Sequence
  Core polypeptide
YTSLIHSLIEESQNQQEKNEQEL

SEQ ID NO: 1643 - protein, 24 aa, Artificial Sequence
  Core polypeptide
YTSLIHSLIEESQNQQEKNEQELL

SEQ ID NO: 1644 - protein, 25 aa, Artificial Sequence
  Core polypeptide
YTSLIHSLIEESQNQQEKNEQELLE

SEQ ID NO: 1645 - protein, 26 aa, Artificial Sequence
  Core polypeptide
YTSLIHSLIEESQNQQEKNEQELLEL

SEQ ID NO: 1646 - protein, 27 aa, Artificial Sequence
  Core polypeptide
YTSLIHSLIEESQNQQEKNEQELLELD

SEQ ID NO: 1647 - protein, 28 aa, Artificial Sequence
  Core polypeptide
YTSLIHSLIEESQNQQEKNEQELLELDK

SEQ ID NO: 1648 - protein, 29 aa, Artificial Sequence
  Core polypeptide
YTSLIHSLIEESQNQQEKNEQELLELDKW

SEQ ID NO: 1649 - protein, 30 aa, Artificial Sequence; identical to SEQ ID NO: 907
  Core polypeptide

SEQ ID NO: 1650 - protein, 31 aa, Artificial Sequence; identical to SEQ ID NO: 744
  Core polypeptide

SEQ ID NO: 1651 - protein, 32 aa, Artificial Sequence; identical to SEQ ID NO: 743
  Core polypeptide

SEQ ID NO: 1652 - protein, 33 aa, Artificial Sequence; identical to SEQ ID NO: 742
  Core polypeptide

SEQ ID NO: 1653 - protein, 34 aa, Artificial Sequence; identical to SEQ ID NO: 741
  Core polypeptide

SEQ ID NO: 1654 - protein, 35 aa, Artificial Sequence; identical to SEQ ID NO: 795
  Core polypeptide

SEQ ID NO: 1655 - protein, 3 aa, Artificial Sequence
  Core polypeptide
NWF

SEQ ID NO: 1656 - protein, 4 aa, Artificial Sequence
  Core polypeptide
WNWF

SEQ ID NO: 1657 - protein, 5 aa, Artificial Sequence
  Core polypeptide
LWNWF

SEQ ID NO: 1658 - protein, 6 aa, Artificial Sequence
  Core polypeptide
SLWNWF

SEQ ID NO: 1659 - protein, 7 aa, Artificial Sequence
  Core polypeptide
ASLWNWF

SEQ ID NO: 1660 - protein, 8 aa, Artificial Sequence
  Core polypeptide
WASLWNWF

SEQ ID NO: 1661 - protein, 9 aa, Artificial Sequence
  Core polypeptide
KWASLWNWF

SEQ ID NO: 1662 - protein, 10 aa, Artificial Sequence
  Core polypeptide
DKWASLWNWF

SEQ ID NO: 1663 - protein, 11 aa, Artificial Sequence
  Core polypeptide
LDKWASLWNWF

SEQ ID NO: 1664 - protein, 12 aa, Artificial Sequence
  Core polypeptide
ELDKWASLWNWF

SEQ ID NO: 1665 - protein, 13 aa, Artificial Sequence
  Core polypeptide
LELDKWASLWNWF

SEQ ID NO: 1666 - protein, 14 aa, Artificial Sequence
  Core polypeptide
LLELDKWASLWNWF

SEQ ID NO: 1667 - protein, 15 aa, Artificial Sequence
  Core polypeptide
ELLELDKWASLWNWF

SEQ ID NO: 1668 - protein, 16 aa, Artificial Sequence
  Core polypeptide
QELLELDKWASLWNWF

SEQ ID NO: 1669 - protein, 17 aa, Artificial Sequence
  Core polypeptide
EQELLELDKWASLWNWF

SEQ ID NO: 1670 - protein, 18 aa, Artificial Sequence
  Core polypeptide
NEQELLELDKWASLWNWF

SEQ ID NO: 1671 - protein, 19 aa, Artificial Sequence
  Core polypeptide
KNEQELLELDKWASLWNWF

SEQ ID NO: 1672 - protein, 20 aa, Artificial Sequence
  Core polypeptide
EKNEQELLELDKWASLWNWF

SEQ ID NO: 1673 - protein, 21 aa, Artificial Sequence
  Core polypeptide
QEKNEQELLELDKWASLWNWF

SEQ ID NO: 1674 - protein, 22 aa, Artificial Sequence
  Core polypeptide
QQEKNEQELLELDKWASLWNWF

SEQ ID NO: 1675 - protein, 23 aa, Artificial Sequence
  Core polypeptide
NQQEKNEQELLELDKWASLWNWF

SEQ ID NO: 1676 - protein, 24 aa, Artificial Sequence
  Core polypeptide
QNQQEKNEQELLELDKWASLWNWF

SEQ ID NO: 1677 - protein, 25 aa, Artificial Sequence
  Core polypeptide
SQNQQEKNEQELLELDKWASLWNWF

SEQ ID NO: 1678 - protein, 26 aa, Artificial Sequence
  Core polypeptide
ESQNQQEKNEQELLELDKWASLWNWF

SEQ ID NO: 1679 - protein, 27 aa, Artificial Sequence
  Core polypeptide
EESQNQQEKNEQELLELDKWASLWNWF

SEQ ID NO: 1680 - protein, 28 aa, Artificial Sequence
  Core polypeptide
IEESQNQQEKNEQELLELDKWASLWNWF

SEQ ID NO: 1681 - protein, 29 aa, Artificial Sequence
  Core polypeptide
LIEESQNQQEKNEQELLELDKWASLWNWF

SEQ ID NO: 1682 - protein, 30 aa, Artificial Sequence; identical to SEQ ID NO: 794
  Core polypeptide

SEQ ID NO: 1683 - protein, 31 aa, Artificial Sequence; identical to SEQ ID NO: 641
  Core polypeptide

SEQ ID NO: 1684 - protein, 32 aa, Artificial Sequence; identical to SEQ ID NO: 802
  Core polypeptide

SEQ ID NO: 1685 - protein, 33 aa, Artificial Sequence; identical to SEQ ID NO: 61
  Core polypeptide

SEQ ID NO: 1686 - protein, 34 aa, Artificial Sequence; identical to SEQ ID NO: 800
  Core polypeptide

SEQ ID NO: 1687 - protein, 35 aa, Artificial Sequence; identical to SEQ ID NO: 638
  Core polypeptide

SEQ ID NO: 1688 - protein, 3 aa, Artificial Sequence
  Core polypeptide
NNL

SEQ ID NO: 1689 - protein, 4 aa, Artificial Sequence
  Core polypeptide
NNLL

SEQ ID NO: 1690 - protein, 5 aa, Artificial Sequence
  Core polypeptide
NNLLR

SEQ ID NO: 1691 - protein, 6 aa, Artificial Sequence
  Core polypeptide
NNLLRA

SEQ ID NO: 1692 - protein, 7 aa, Artificial Sequence
  Core polypeptide
NNLLRAI

SEQ ID NO: 1693 - protein, 8 aa, Artificial Sequence
  Core polypeptide
NNLLRAIE

SEQ ID NO: 1694 - protein, 9 aa, Artificial Sequence
  Core polypeptide
NNLLRAIEA

SEQ ID NO: 1695 - protein, 10 aa, Artificial Sequence
  Core polypeptide
NNLLRAIEAQ

SEQ ID NO: 1696 - protein, 11 aa, Artificial Sequence
  Core polypeptide
NNLLRAIEAQQ

SEQ ID NO: 1697 - protein, 12 aa, Artificial Sequence
  Core polypeptide
NNLLRAIEAQQH

SEQ ID NO: 1698 - protein, 13 aa, Artificial Sequence
  Core polypeptide
NNLLRAIEAQQHL

SEQ ID NO: 1699 - protein, 14 aa, Artificial Sequence
  Core polypeptide
NNLLRAIEAQQHLL

SEQ ID NO: 1700 - protein, 15 aa, Artificial Sequence
  Core polypeptide
NNLLRAIEAQQHLLQ

SEQ ID NO: 1701 - protein, 16 aa, Artificial Sequence
  Core polypeptide
NNLLRAIEAQQHLLQL

SEQ ID NO: 1702 - protein, 17 aa, Artificial Sequence
  Core polypeptide
NNLLRAIEAQQHLLQLT

SEQ ID NO: 1703 - protein, 18 aa, Artificial Sequence
  Core polypeptide
NNLLRAIEAQQHLLQLTV

SEQ ID NO: 1704 - protein, 19 aa, Artificial Sequence
  Core polypeptide
NNLLRAIEAQQHLLQLTVW

SEQ ID NO: 1705 - protein, 20 aa, Artificial Sequence
  Core polypeptide
NNLLRAIEAQQHLLQLTVWG

SEQ ID NO: 1706 - protein, 21 aa, Artificial Sequence
  Core polypeptide
NNLLRAIEAQQHLLQLTVWGI

SEQ ID NO: 1707 - protein, 22 aa, Artificial Sequence
  Core polypeptide
NNLLRAIEAQQHLLQLTVWGIK

SEQ ID NO: 1708 - protein, 23 aa, Artificial Sequence
  Core polypeptide
NNLLRAIEAQQHLLQLTVWGIKQ

SEQ ID NO: 1709 - protein, 24 aa, Artificial Sequence
  Core polypeptide
NNLLRAIEAQQHLLQLTVWGIKQL

SEQ ID NO: 1710 - protein, 25 aa, Artificial Sequence
  Core polypeptide
NNLLRAIEAQQHLLQLTVWGIKQLQ

SEQ ID NO: 1711 - protein, 26 aa, Artificial Sequence
  Core polypeptide
NNLLRAIEAQQHLLQLTVWGIKQLQA

SEQ ID NO: 1712 - protein, 27 aa, Artificial Sequence
  Core polypeptide
NNLLRAIEAQQHLLQLTVWGIKQLQAR

SEQ ID NO: 1713 - protein, 28 aa, Artificial Sequence
  Core polypeptide
NNLLRAIEAQQHLLQLTVWGIKQLQARI

SEQ ID NO: 1714 - protein, 29 aa, Artificial Sequence
  Core polypeptide
NNLLRAIEAQQHLLQLTVWGIKQLQARIL

SEQ ID NO: 1715 - protein, 30 aa, Artificial Sequence
  Core polypeptide
NNLLRAIEAQQHLLQLTVWGIKQLQARILA

SEQ ID NO: 1716 - protein, 31 aa, Artificial Sequence
  Core polypeptide
NNLLRAIEAQQHLLQLTVWGIKQLQARILAV

SEQ ID NO: 1717 - protein, 32 aa, Artificial Sequence
  Core polypeptide
NNLLRAIEAQQHLLQLTVWGIKQLQARILAVE

SEQ ID NO: 1718 - protein, 33 aa, Artificial Sequence
  Core polypeptide
NNLLRAIEAQQHLLQLTVWGIKQLQARILAVER

SEQ ID NO: 1719 - protein, 34 aa, Artificial Sequence
  Core polypeptide
NNLLRAIEAQQHLLQLTVWGIKQLQARILAVERY

SEQ ID NO: 1720 - protein, 35 aa, Artificial Sequence
  Core polypeptide
NNLLRAIEAQQHLLQLTVWGIKQLQARILAVERYL

SEQ ID NO: 1721 - protein, 36 aa, Artificial Sequence
  Core polypeptide
NNLLRAIEAQQHLLQLTVWGIKQLQARILAVERYLK

SEQ ID NO: 1722 - protein, 37 aa, Artificial Sequence
  Core polypeptide
NNLLRAIEAQQHLLQLTVWGIKQLQARILAVERYLKD

SEQ ID NO: 1723 - protein, 3 aa, Artificial Sequence
  Core polypeptide
KDQ

SEQ ID NO: 1724 - protein, 4 aa, Artificial Sequence
  Core polypeptide
LKDQ

SEQ ID NO: 1725 - protein, 5 aa, Artificial Sequence
  Core polypeptide
YLKDQ

SEQ ID NO: 1726 - protein, 6 aa, Artificial Sequence
  Core polypeptide
RYLKDQ

SEQ ID NO: 1727 - protein, 7 aa, Artificial Sequence
  Core polypeptide
ERYLKDQ

SEQ ID NO: 1728 - protein, 8 aa, Artificial Sequence
  Core polypeptide
VERYLKDQ

SEQ ID NO: 1729 - protein, 9 aa, Artificial Sequence
  Core polypeptide
AVERYLKDQ

SEQ ID NO: 1730 - protein, 10 aa, Artificial Sequence
  Core polypeptide
LAVERYLKDQ

SEQ ID NO: 1731 - protein, 11 aa, Artificial Sequence
  Core polypeptide
ILAVERYLKDQ

SEQ ID NO: 1732 - protein, 12 aa, Artificial Sequence
  Core polypeptide
RILAVERYLKDQ

SEQ ID NO: 1733 - protein, 13 aa, Artificial Sequence
  Core polypeptide
ARILAVERYLKDQ

SEQ ID NO: 1734 - protein, 14 aa, Artificial Sequence
  Core polypeptide
QARILAVERYLKDQ

SEQ ID NO: 1735 - protein, 15 aa, Artificial Sequence
  Core polypeptide
LQARILAVERYLKDQ

SEQ ID NO: 1736 - protein, 16 aa, Artificial Sequence
  Core polypeptide
QLQARILAVERYLKDQ

SEQ ID NO: 1737 - protein, 17 aa, Artificial Sequence
  Core polypeptide
KQLQARILAVERYLKDQ

SEQ ID NO: 1738 - protein, 18 aa, Artificial Sequence
  Core polypeptide
IKQLQARILAVERYLKDQ

SEQ ID NO: 1739 - protein, 19 aa, Artificial Sequence
  Core polypeptide
GIKQLQARILAVERYLKDQ

SEQ ID NO: 1740 - protein, 20 aa, Artificial Sequence
  Core polypeptide
WGIKQLQARILAVERYLKDQ

SEQ ID NO: 1741 - protein, 21 aa, Artificial Sequence
  Core polypeptide
VWGIKQLQARILAVERYLKDQ

SEQ ID NO: 1742 - protein, 22 aa, Artificial Sequence
  Core polypeptide
TVWGIKQLQARILAVERYLKDQ

SEQ ID NO: 1743 - protein, 23 aa, Artificial Sequence
  Core polypeptide
LTVWGIKQLQARILAVERYLKDQ

SEQ ID NO: 1744 - protein, 24 aa, Artificial Sequence
  Core polypeptide
QLTVWGIKQLQARILAVERYLKDQ

SEQ ID NO: 1745 - protein, 25 aa, Artificial Sequence
  Core polypeptide
LQLTVWGIKQLQARILAVERYLKDQ

SEQ ID NO: 1746 - protein, 26 aa, Artificial Sequence
  Core polypeptide
LLQLTVWGIKQLQARILAVERYLKDQ

SEQ ID NO: 1747 - protein, 27 aa, Artificial Sequence
  Core polypeptide
HLLQLTVWGIKQLQARILAVERYLKDQ

SEQ ID NO: 1748 - protein, 28 aa, Artificial Sequence
  Core polypeptide
QHLLQLTVWGIKQLQARILAVERYLKDQ

SEQ ID NO: 1749 - protein, 29 aa, Artificial Sequence
  Core polypeptide
QQHLLQLTVWGIKQLQARILAVERYLKDQ

SEQ ID NO: 1750 - protein, 30 aa, Artificial Sequence
  Core polypeptide
AQQHLLQLTVWGIKQLQARILAVERYLKDQ

SEQ ID NO: 1751 - protein, 31 aa, Artificial Sequence
  Core polypeptide
EAQQHLLQLTVWGIKQLQARILAVERYLKDQ

SEQ ID NO: 1752 - protein, 32 aa, Artificial Sequence
  Core polypeptide
IEAQQHLLQLTVWGIKQLQARILAVERYLKDQ

SEQ ID NO: 1753 - protein, 33 aa, Artificial Sequence
  Core polypeptide
AIEAQQHLLQLTVWGIKQLQARILAVERYLKDQ

SEQ ID NO: 1754 - protein, 34 aa, Artificial Sequence
  Core polypeptide
RAIEAQQHLLQLTVWGIKQLQARILAVERYLKDQ

SEQ ID NO: 1755 - protein, 35 aa, Artificial Sequence
  Core polypeptide
LRAIEAQQHLLQLTVWGIKQLQARILAVERYLKDQ

SEQ ID NO: 1756 - protein, 36 aa, Artificial Sequence
  Core polypeptide
LLRAIEAQQHLLQLTVWGIKQLQARILAVERYLKDQ

SEQ ID NO: 1757 - protein, 37 aa, Artificial Sequence
  Core polypeptide
NLLRAIEAQQHLLQLTVWGIKQLQARILAVERYLKDQ

SEQ ID NO: 1758 - protein, 49 aa, Artificial Sequence
  Core polypeptide
VSKVLHLEGEVNKIKSALLSTNKAVVSLSNGVSVLTSKVLDLKNYIDKQ

SEQ ID NO: 1759 - protein, 48 aa, Artificial Sequence; identical to SEQ ID NO: 1546
  Core polypeptide

SEQ ID NO: 1760 - protein, 47 aa, Artificial Sequence
  Core polypeptide
KVLHLEGEVNKIKSALLSTNKAVVSLSNGVSVLTSKVLDLKNYIDKQ

SEQ ID NO: 1761 - protein, 46 aa, Artificial Sequence; identical to SEQ ID NO: 1544
  Core polypeptide

SEQ ID NO: 1762 - protein, 45 aa, Artificial Sequence
  Core polypeptide
LHLEGEVNKIKSALLSTNKAVVSLSNGVSVLTSKVLDLKNYIDKQ

SEQ ID NO: 1763 - protein, 44 aa, Artificial Sequence
  Core polypeptide
HLEGEVNKIKSALLSTNKAVVSLSNGVSVLTSKVLDLKNYIDKQ

SEQ ID NO: 1764 - protein, 43 aa, Artificial Sequence
  Core polypeptide
LEGEVNKIKSALLSTNKAVVSLSNGVSVLTSKVLDLKNYIDKQ

SEQ ID NO: 1765 - protein, 42 aa, Artificial Sequence
  Core polypeptide
EGEVNKIKSALLSTNKAVVSLSNGVSVLTSKVLDLKNYIDKQ

SEQ ID NO: 1766 - protein, 41 aa, Artificial Sequence
  Core polypeptide
GEVNKIKSALLSTNKAVVSLSNGVSVLTSKVLDLKNYIDKQ

SEQ ID NO: 1767 - protein, 40 aa, Artificial Sequence
  Core polypeptide
EVNKIKSALLSTNKAVVSLSNGVSVLTSKVLDLKNYIDKQ

SEQ ID NO: 1768 - protein, 39 aa, Artificial Sequence
  Core polypeptide
VNKIKSALLSTNKAVVSLSNGVSVLTSKVLDLKNYIDKQ

SEQ ID NO: 1769 - protein, 38 aa, Artificial Sequence
  Core polypeptide
NKIKSALLSTNKAVVSLSNGVSVLTSKVLDLKNYIDKQ

SEQ ID NO: 1770 - protein, 37 aa, Artificial Sequence
  Core polypeptide
KIKSALLSTNKAVVSLSNGVSVLTSKVLDLKNYIDKQ

SEQ ID NO: 1771 - protein, 36 aa, Artificial Sequence
  Core polypeptide
IKSALLSTNKAVVSLSNGVSVLTSKVLDLKNYIDKQ

SEQ ID NO: 1772 - protein, 35 aa, Artificial Sequence; identical to SEQ ID NO: 135
  Core polypeptide

SEQ ID NO: 1773 - protein, 34 aa, Artificial Sequence
  Core polypeptide
SALLSTNKAVVSLSNGVSVLTSKVLDLKNYIDKQ

SEQ ID NO: 1774 - protein, 33 aa, Artificial Sequence
  Core polypeptide
ALLSTNKAVVSLSNGVSVLTSKVLDLKNYIDKQ

SEQ ID NO: 1775 - protein, 32 aa, Artificial Sequence
  Core polypeptide
LLSTNKAVVSLSNGVSVLTSKVLDLKNYIDKQ

SEQ ID NO: 1776 - protein, 31 aa, Artificial Sequence
  Core polypeptide
LSTNKAVVSLSNGVSVLTSKVLDLKNYIDKQ

SEQ ID NO: 1777 - protein, 30 aa, Artificial Sequence
  Core polypeptide
STNKAVVSLSNGVSVLTSKVLDLKNYIDKQ

SEQ ID NO: 1778 - protein, 29 aa, Artificial Sequence
  Core polypeptide
TNKAVVSLSNGVSVLTSKVLDLKNYIDKQ

SEQ ID NO: 1779 - protein, 28 aa, Artificial Sequence
  Core polypeptide
NKAVVSLSNGVSVLTSKVLDLKNYIDKQ

SEQ ID NO: 1780 - protein, 27 aa, Artificial Sequence
  Core polypeptide
KAVVSLSNGVSVLTSKVLDLKNYIDKQ

SEQ ID NO: 1781 - protein, 26 aa, Artificial Sequence
  Core polypeptide
AVVSLSNGVSVLTSKVLDLKNYIDKQ

SEQ ID NO: 1782 - protein, 25 aa, Artificial Sequence
  Core polypeptide
VVSLSNGVSVLTSKVLDLKNYIDKQ

SEQ ID NO: 1783 - protein, 24 aa, Artificial Sequence
  Core polypeptide
VSLSNGVSVLTSKVLDLKNYIDKQ

SEQ ID NO: 1784 - protein, 23 aa, Artificial Sequence
  Core polypeptide
SLSNGVSVLTSKVLDLKNYIDKQ

SEQ ID NO: 1785 - protein, 22 aa, Artificial Sequence
  Core polypeptide
LSNGVSVLTSKVLDLKNYIDKQ

SEQ ID NO: 1786 - protein, 21 aa, Artificial Sequence
  Core polypeptide
SNGVSVLTSKVLDLKNYIDKQ

SEQ ID NO: 1787 - protein, 20 aa, Artificial Sequence
  Core polypeptide
NGVSVLTSKVLDLKNYIDKQ

SEQ ID NO: 1788 - protein, 19 aa, Artificial Sequence
  Core polypeptide
GVSVLTSKVLDLKNYIDKQ

SEQ ID NO: 1789 - protein, 18 aa, Artificial Sequence
  Core polypeptide
VSVLTSKVLDLKNYIDKQ

SEQ ID NO: 1790 - protein, 17 aa, Artificial Sequence
  Core polypeptide
SVLTSKVLDLKNYIDKQ

SEQ ID NO: 1791 - protein, 16 aa, Artificial Sequence
  Core polypeptide
VLTSKVLDLKNYIDKQ

SEQ ID NO: 1792 - protein, 15 aa, Artificial Sequence
  Core polypeptide
LTSKVLDLKNYIDKQ

SEQ ID NO: 1793 - protein, 14 aa, Artificial Sequence
  Core polypeptide
TSKVLDLKNYIDKQ

SEQ ID NO: 1794 - protein, 13 aa, Artificial Sequence
  Core polypeptide
SKVLDLKNYIDKQ

SEQ ID NO: 1795 - protein, 12 aa, Artificial Sequence
  Core polypeptide
KVLDLKNYIDKQ

SEQ ID NO: 1796 - protein, 11 aa, Artificial Sequence
  Core polypeptide
VLDLKNYIDKQ

SEQ ID NO: 1797 - protein, 10 aa, Artificial Sequence
  Core polypeptide
LDLKNYIDKQ

SEQ ID NO: 1798 - protein, 9 aa, Artificial Sequence
  Core polypeptide
DLKNYIDKQ

SEQ ID NO: 1799 - protein, 8 aa, Artificial Sequence
  Core polypeptide
LKNYIDKQ

SEQ ID NO: 1800 - protein, 7 aa, Artificial Sequence
  Core polypeptide
KNYIDKQ

SEQ ID NO: 1801 - protein, 6 aa, Artificial Sequence
  Core polypeptide
NYIDKQ

SEQ ID NO: 1802 - protein, 5 aa, Artificial Sequence
  Core polypeptide
YIDKQ

SEQ ID NO: 1803 - protein, 4 aa, Artificial Sequence
  Core polypeptide
IDKQ

SEQ ID NO: 1804 - protein, 3 aa, Artificial Sequence
  Core polypeptide
DKQ

SEQ ID NO: 1805 - protein, 49 aa, Artificial Sequence
  Core polypeptide
AVSKVLHLEGEVNKIKSALLSTNKAVVSLSNGVSVLTSKVLDLKNYIDK

SEQ ID NO: 1806 - protein, 48 aa, Artificial Sequence
  Core polypeptide
AVSKVLHLEGEVNKIKSALLSTNKAVVSLSNGVSVLTSKVLDLKNYID

SEQ ID NO: 1807 - protein, 47 aa, Artificial Sequence
  Core polypeptide
AVSKVLHLEGEVNKIKSALLSTNKAVVSLSNGVSVLTSKVLDLKNYI

SEQ ID NO: 1808 - protein, 46 aa, Artificial Sequence
  Core polypeptide
AVSKVLHLEGEVNKIKSALLSTNKAVVSLSNGVSVLTSKVLDLKNY

SEQ ID NO: 1809 - protein, 45 aa, Artificial Sequence
  Core polypeptide
AVSKVLHLEGEVNKIKSALLSTNKAVVSLSNGVSVLTSKVLDLKN

SEQ ID NO: 1810 - protein, 44 aa, Artificial Sequence
  Core polypeptide
AVSKVLHLEGEVNKIKSALLSTNKAVVSLSNGVSVLTSKVLDLK

SEQ ID NO: 1811 - protein, 43 aa, Artificial Sequence
  Core polypeptide
AVSKVLHLEGEVNKIKSALLSTNKAVVSLSNGVSVLTSKVLDL

SEQ ID NO: 1812 - protein, 42 aa, Artificial Sequence
  Core polypeptide
AVSKVLHLEGEVNKIKSALLSTNKAVVSLSNGVSVLTSKVLD

SEQ ID NO: 1813 - protein, 41 aa, Artificial Sequence
  Core polypeptide
AVSKVLHLEGEVNKIKSALLSTNKAVVSLSNGVSVLTSKVL

SEQ ID NO: 1814 - protein, 40 aa, Artificial Sequence
  Core polypeptide
AVSKVLHLEGEVNKIKSALLSTNKAVVSLSNGVSVLTSKV

SEQ ID NO: 1815 - protein, 39 aa, Artificial Sequence
  Core polypeptide
AVSKVLHLEGEVNKIKSALLSTNKAVVSLSNGVSVLTSK

SEQ ID NO: 1816 - protein, 38 aa, Artificial Sequence
  Core polypeptide
AVSKVLHLEGEVNKIKSALLSTNKAVVSLSNGVSVLTS

SEQ ID NO: 1817 - protein, 37 aa, Artificial Sequence
  Core polypeptide
AVSKVLHLEGEVNKIKSALLSTNKAVVSLSNGVSVLT

SEQ ID NO: 1818 - protein, 36 aa, Artificial Sequence
  Core polypeptide
AVSKVLHLEGEVNKIKSALLSTNKAVVSLSNGVSVL

SEQ ID NO: 1819 - protein, 35 aa, Artificial Sequence; identical to SEQ ID NO: 120
  Core polypeptide

SEQ ID NO: 1820 - protein, 34 aa, Artificial Sequence
  Core polypeptide
AVSKVLHLEGEVNKIKSALLSTNKAVVSLSNGVS

SEQ ID NO: 1821 - protein, 33 aa, Artificial Sequence
  Core polypeptide
AVSKVLHLEGEVNKIKSALLSTNKAVVSLSNGV

SEQ ID NO: 1822 - protein, 32 aa, Artificial Sequence
  Core polypeptide
AVSKVLHLEGEVNKIKSALLSTNKAVVSLSNG

SEQ ID NO: 1823 - protein, 31 aa, Artificial Sequence
  Core polypeptide
AVSKVLHLEGEVNKIKSALLSTNKAVVSLSN

SEQ ID NO: 1824 - protein, 30 aa, Artificial Sequence
  Core polypeptide
AVSKVLHLEGEVNKIKSALLSTNKAVVSLS

SEQ ID NO: 1825 - protein, 29 aa, Artificial Sequence
  Core polypeptide
AVSKVLHLEGEVNKIKSALLSTNKAVVSL

SEQ ID NO: 1826 - protein, 28 aa, Artificial Sequence
  Core polypeptide
AVSKVLHLEGEVNKIKSALLSTNKAVVS

SEQ ID NO: 1827 - protein, 27 aa, Artificial Sequence
  Core polypeptide
AVSKVLHLEGEVNKIKSALLSTNKAVV

SEQ ID NO: 1828 - protein, 26 aa, Artificial Sequence
  Core polypeptide
AVSKVLHLEGEVNKIKSALLSTNKAV

SEQ ID NO: 1829 - protein, 25 aa, Artificial Sequence
  Core polypeptide
AVSKVLHLEGEVNKIKSALLSTNKA

SEQ ID NO: 1830 - protein, 24 aa, Artificial Sequence
  Core polypeptide
AVSKVLHLEGEVNKIKSALLSTNK

SEQ ID NO: 1831 - protein, 23 aa, Artificial Sequence
  Core polypeptide
AVSKVLHLEGEVNKIKSALLSTN

SEQ ID NO: 1832 - protein, 22 aa, Artificial Sequence
  Core polypeptide
AVSKVLHLEGEVNKIKSALLST

SEQ ID NO: 1833 - protein, 21 aa, Artificial Sequence
  Core polypeptide
AVSKVLHLEGEVNKIKSALLS

SEQ ID NO: 1834 - protein, 20 aa, Artificial Sequence
  Core polypeptide
AVSKVLHLEGEVNKIKSALL

SEQ ID NO: 1835 - protein, 19 aa, Artificial Sequence
  Core polypeptide
AVSKVLHLEGEVNKIKSAL

SEQ ID NO: 1836 - protein, 18 aa, Artificial Sequence
  Core polypeptide
AVSKVLHLEGEVNKIKSA

SEQ ID NO: 1837 - protein, 17 aa, Artificial Sequence
  Core polypeptide
AVSKVLHLEGEVNKIKS

SEQ ID NO: 1838 - protein, 16 aa, Artificial Sequence
  Core polypeptide
AVSKVLHLEGEVNKIK

SEQ ID NO: 1839 - protein, 15 aa, Artificial Sequence
  Core polypeptide
AVSKVLHLEGEVNKI

SEQ ID NO: 1840 - protein, 14 aa, Artificial Sequence
  Core polypeptide
AVSKVLHLEGEVNK

SEQ ID NO: 1841 - protein, 13 aa, Artificial Sequence
  Core polypeptide
AVSKVLHLEGEVN

SEQ ID NO: 1842 - protein, 12 aa, Artificial Sequence
  Core polypeptide
AVSKVLHLEGEV

SEQ ID NO: 1843 - protein, 11 aa, Artificial Sequence
  Core polypeptide
AVSKVLHLEGE

SEQ ID NO: 1844 - protein, 10 aa, Artificial Sequence
  Core polypeptide
AVSKVLHLEG

SEQ ID NO: 1845 - protein, 9 aa, Artificial Sequence
  Core polypeptide
AVSKVLHLE

SEQ ID NO: 1846 - protein, 8 aa, Artificial Sequence
  Core polypeptide
AVSKVLHL

SEQ ID NO: 1847 - protein, 7 aa, Artificial Sequence
  Core polypeptide
AVSKVLH

SEQ ID NO: 1848 - protein, 6 aa, Artificial Sequence
  Core polypeptide
AVSKVL

SEQ ID NO: 1849 - protein, 5 aa, Artificial Sequence
  Core polypeptide
AVSKV

SEQ ID NO: 1850 - protein, 4 aa, Artificial Sequence
  Core polypeptide
AVSK

SEQ ID NO: 1851 - protein, 3 aa, Artificial Sequence
  Core polypeptide
AVS

SEQ ID NO: 1852 - protein, 45 aa, Artificial Sequence; identical to SEQ ID NO: 1545
  Core polypeptide

SEQ ID NO: 1853 - protein, 44 aa, Artificial Sequence; identical to SEQ ID NO: 1548
  Core polypeptide

SEQ ID NO: 1854 - protein, 43 aa, Artificial Sequence; identical to SEQ ID NO: 1549
  Core polypeptide

SEQ ID NO: 1855 - protein, 42 aa, Artificial Sequence
  Core polypeptide
VLHLEGEVNKIKSALLSTNKAVVSLSNGVSVLTSKVLDLKNY

SEQ ID NO: 1856 - protein, 41 aa, Artificial Sequence
  Core polypeptide
VLHLEGEVNKIKSALLSTNKAVVSLSNGVSVLTSKVLDLKN

SEQ ID NO: 1857 - protein, 40 aa, Artificial Sequence
  Core polypeptide
VLHLEGEVNKIKSALLSTNKAVVSLSNGVSVLTSKVLDLK

SEQ ID NO: 1858 - protein, 39 aa, Artificial Sequence
  Core polypeptide
VLHLEGEVNKIKSALLSTNKAVVSLSNGVSVLTSKVLDL

SEQ ID NO: 1859 - protein, 38 aa, Artificial Sequence
  Core polypeptide
VLHLEGEVNKIKSALLSTNKAVVSLSNGVSVLTSKVLD

SEQ ID NO: 1860 - protein, 37 aa, Artificial Sequence
  Core polypeptide
VLHLEGEVNKIKSALLSTNKAVVSLSNGVSVLTSKVL

SEQ ID NO: 1861 - protein, 36 aa, Artificial Sequence
  Core polypeptide
VLHLEGEVNKIKSALLSTNKAVVSLSNGVSVLTSKV

SEQ ID NO: 1862 - protein, 35 aa, Artificial Sequence; identical to SEQ ID NO: 124
  Core polypeptide

SEQ ID NO: 1863 - protein, 34 aa, Artificial Sequence
  Core polypeptide
VLHLEGEVNKIKSALLSTNKAVVSLSNGVSVLTS

SEQ ID NO: 1864 - protein, 33 aa, Artificial Sequence
  Core polypeptide
VLHLEGEVNKIKSALLSTNKAVVSLSNGVSVLT

SEQ ID NO: 1865 - protein, 32 aa, Artificial Sequence
  Core polypeptide
VLHLEGEVNKIKSALLSTNKAVVSLSNGVSVL

SEQ ID NO: 1866 - protein, 31 aa, Artificial Sequence
  Core polypeptide
VLHLEGEVNKIKSALLSTNKAVVSLSNGVSV

SEQ ID NO: 1867 - protein, 30 aa, Artificial Sequence
  Core polypeptide
VLHLEGEVNKIKSALLSTNKAVVSLSNGVS

SEQ ID NO: 1868 - protein, 29 aa, Artificial Sequence
  Core polypeptide
VLHLEGEVNKIKSALLSTNKAVVSLSNGV

SEQ ID NO: 1869 - protein, 28 aa, Artificial Sequence
  Core polypeptide
VLHLEGEVNKIKSALLSTNKAVVSLSNG

SEQ ID NO: 1870 - protein, 27 aa, Artificial Sequence
  Core polypeptide
VLHLEGEVNKIKSALLSTNKAVVSLSN

SEQ ID NO: 1871 - protein, 26 aa, Artificial Sequence
  Core polypeptide
VLHLEGEVNKIKSALLSTNKAVVSLS

SEQ ID NO: 1872 - protein, 25 aa, Artificial Sequence
  Core polypeptide
VLHLEGEVNKIKSALLSTNKAVVSL

SEQ ID NO: 1873 - protein, 24 aa, Artificial Sequence
  Core polypeptide
VLHLEGEVNKIKSALLSTNKAVVS

SEQ ID NO: 1874 - protein, 23 aa, Artificial Sequence
  Core polypeptide
VLHLEGEVNKIKSALLSTNKAVV

SEQ ID NO: 1875 - protein, 22 aa, Artificial Sequence
  Core polypeptide
VLHLEGEVNKIKSALLSTNKAV

SEQ ID NO: 1876 - protein, 21 aa, Artificial Sequence
  Core polypeptide
VLHLEGEVNKIKSALLSTNKA

SEQ ID NO: 1877 - protein, 20 aa, Artificial Sequence
  Core polypeptide
VLHLEGEVNKIKSALLSTNK

SEQ ID NO: 1878 - protein, 19 aa, Artificial Sequence
  Core polypeptide
VLHLEGEVNKIKSALLSTN

SEQ ID NO: 1879 - protein, 18 aa, Artificial Sequence
  Core polypeptide
VLHLEGEVNKIKSALLST

SEQ ID NO: 1880 - protein, 17 aa, Artificial Sequence
  Core polypeptide
VLHLEGEVNKIKSALLS

SEQ ID NO: 1881 - protein, 16 aa, Artificial Sequence
  Core polypeptide
VLHLEGEVNKIKSALL

SEQ ID NO: 1882 - protein, 15 aa, Artificial Sequence
  Core polypeptide
VLHLEGEVNKIKSAL

SEQ ID NO: 1883 - protein, 14 aa, Artificial Sequence
  Core polypeptide
VLHLEGEVNKIKSA

SEQ ID NO: 1884 - protein, 13 aa, Artificial Sequence
  Core polypeptide
VLHLEGEVNKIKS

SEQ ID NO: 1885 - protein, 12 aa, Artificial Sequence
  Core polypeptide
VLHLEGEVNKIK

SEQ ID NO: 1886 - protein, 11 aa, Artificial Sequence
  Core polypeptide
VLHLEGEVNKI

SEQ ID NO: 1887 - protein, 10 aa, Artificial Sequence
  Core polypeptide
VLHLEGEVNK

SEQ ID NO: 1888 - protein, 9 aa, Artificial Sequence
  Core polypeptide
VLHLEGEVN

SEQ ID NO: 1889 - protein, 8 aa, Artificial Sequence
  Core polypeptide
VLHLEGEV

SEQ ID NO: 1890 - protein, 7 aa, Artificial Sequence
  Core polypeptide
VLHLEGE

SEQ ID NO: 1891 - protein, 6 aa, Artificial Sequence
  Core polypeptide
VLHLEG

SEQ ID NO: 1892 - protein, 5 aa, Artificial Sequence
  Core polypeptide
VLHLE

SEQ ID NO: 1893 - protein, 4 aa, Artificial Sequence
  Core polypeptide
VLHL

SEQ ID NO: 1894 - protein, 3 aa, Artificial Sequence
  Core polypeptide
VLH

SEQ ID NO: 1895 - protein, 5 aa, Artificial Sequence
  Core polypeptide
VLHLE

SEQ ID NO: 1896 - protein, 8 aa, <213>  Core Peptide
LKNYIDKQ

SEQ ID NO: 1897 - DNA, 20 bp, Artificial Sequence
  primer_bind
ggaaggaattcccggttagg

SEQ ID NO: 1898 - DNA, 27 bp, Artificial Sequence
  primer_bind
tgctctagactattgtactacatatgc

SEQ ID NO: 1899 - DNA, 28 bp, Artificial Sequence
  primer_bind
tgctctagactacttagatacagcaacg

SEQ ID NO: 1900 - DNA, 33 bp, Artificial Sequence
  primer_bind
tgctctagactattgtttatctatatagttttt

SEQ ID NO: 1901 - DNA, 29 bp, Artificial Sequence
  primer_bind
tgctctagactagtctaacactttgctgg

SEQ ID NO: 1902 - DNA, 21 bp, Artificial Sequence
  primer_bind
atgacgctgacggtacaggcc

SEQ ID NO: 1903 - DNA, 33 bp, Artificial Sequence
  primer_bind
tgactaagcttaataccacagccaatttgttat

SEQ ID NO: 1904 - DNA, 40 bp, Artificial Sequence
  primer_bind
ccaaatccccaggagctgctcgagctgcactataccagac

SEQ ID NO: 1905 - DNA, 35 bp, Artificial Sequence
  primer_bind
atagcttctagattaattgttaatttctctgtccc

SEQ ID NO: 1906 - DNA, 22 bp, Artificial Sequence
  primer_bind
ggagctgcttggggccccagac

SEQ ID NO: 1907 - protein, 34 aa, Artificial Sequence
  Core polypeptide
  SITE 17: Xaa = U (Aminobutyric Acid)
YTSVITIELSNIKENKXNGTDAVKLIKQELDKYK

SEQ ID NO: 1908 - protein, 34 aa, Artificial Sequence
  Core polypeptide
  SITE 16: Xaa = U (Aminobutyric Acid)
TSVITIELSNIKENKXNGTDAVKLIKQELDKYKN

SEQ ID NO: 1909 - protein, 34 aa, Artificial Sequence
  Core polypeptide
  SITE 15: Xaa = U (Aminobutyric Acid)
SVITIELSNIKENKXNGTDAVKLIKQELDKYKNA

SEQ ID NO: 1910 - protein, 35 aa, Artificial Sequence
  Core polypeptide
  SITE 8: Xaa = U (Aminobutyric Acid)
SNIKENKXNGTDAKVKLIKQELDKYKNAVTELQLL

SEQ ID NO: 1911 - protein, 35 aa, Artificial Sequence
  Core polypeptide
  SITE 5: Xaa = U (Aminobutyric Acid)
KENKXNGTDAKVKLIKQELDKYKNAVTELQLLMQS

SEQ ID NO: 1912 - protein, 35 aa, Artificial Sequence
  Core polypeptide
PPLVLQAGFFLLTRILTIPQSLDSWWTSLNFLGGT

SEQ ID NO: 1913 - protein, 36 aa, Artificial Sequence
  Core polypeptide
  SITE 31: Xaa = U (Aminobutyric Acid)
AVSKGYLSALRTGWYTSVITIELSNIKENKXNGTDA

SEQ ID NO: 1914 - protein, 35 aa, Artificial Sequence
  Core polypeptide
  SITE 33: Xaa = U (Aminobutyric Acid)
RAKFKQLLQHYREVAAAKSSENDRLRLLLKQMXPS

SEQ ID NO: 1915 - protein, 35 aa, Artificial Sequence
  Core polypeptide
  SITE 1, 5: Xaa = Abu (Aminobytyric acid)
XDDEXMNSVKNGTYDYPKYEEESKLNRNEIKGVKL

SEQ ID NO: 1916 - protein, 38 aa, Artificial Sequence
  Core polypeptide
  SITE 2: Xaa = Nle (Norleucine)
MXWMEWDREINNYTSLIHSLIEESQNQQEKNEQELLEL

SEQ ID NO: 1917 - protein, 36 aa, Artificial Sequence
  Core polypeptide
  SITE 2: Xaa = Nle (Norleucine)
WXEWDREINNYTSLIHSLIEESQNQQEKNEQELLEL

SEQ ID NO: 1918 - protein, 10 aa, Artificial Sequence
  Core polypeptide
  SITE 1, 2: Xaa = Aca (aminocaprioc acid)
XXIRKSDELL

SEQ ID NO: 1919 - protein, 36 aa, Artificial Sequence; identical to SEQ ID NO: 1917
  Core polypeptide
  SITE 2: Xaa = Nle (Norleucine)

SEQ ID NO: 1920 - protein, 35 aa, Artificial Sequence
  Core polypeptide
IDISIELNKAKSDLEEAKEWIDDANQKLDSIGNWH

SEQ ID NO: 1921 - protein, 25 aa, Artificial Sequence
  Core polypeptide
YDASISQVNEEINQALAFIRKADEL

SEQ ID NO: 1922 - protein, 26 aa, Artificial Sequence
  Core polypeptide
YDASISQVNEEINQSLAYIRKADELL

SEQ ID NO: 1923 - protein, 35 aa, Artificial Sequence
  Core polypeptide
IDISIELNKAKSDLEESKEWIEKSNQKLDSIGNWH

SEQ ID NO: 1924 - protein, 35 aa, Artificial Sequence
  Core polypeptide
VYPSDEYDASISQVNEKINQSLAYIRKSDELLHNV

SEQ ID NO: 1925 - protein, 35 aa, Artificial Sequence
  Core polypeptide
QWFVFLSPTVWLSVIWMMWYWGPSLYSILSPFLPL

SEQ ID NO: 1926 - protein, 28 aa, Artificial Sequence
  Core polypeptide
  SITE 16: Xaa = Abu (aminobutyric acid)
PTRVNYILIIGVLVLXEVTGVRADVHLL

SEQ ID NO: 1927 - protein, 35 aa, Artificial Sequence
  Core polypeptide
  SITE 16: Xaa = Abu (aminobutyric acid)
PTRVNYILIIGVLVLXEVTGVRADVHLLEQPGNLW

SEQ ID NO: 1928 - protein, 35 aa, Artificial Sequence
  Core polypeptide
  SITE 23: Xaa = Abu (aminobutyric acid)
PEKTPLLPTRVNYILIIGVLVLXEVTGVRADVHLL

SEQ ID NO: 1929 - protein, 39 aa, Artificial Sequence
  Core polypeptide
  SITE 1: Xaa = Aha
XGGGVYPSDEYDASISQVNEEINQALAYIRKADELLENV

SEQ ID NO: 1930 - protein, 11 aa, Artificial Sequence
  Core polypeptide
HWSYALALRPG

SEQ ID NO: 1931 - protein, 35 aa, Artificial Sequence
  Core polypeptide
  SITE 1, 2, 3, 32, 33, 34: Xaa = Aca (aminocaproic acid)
XXXDEFDESISQVNEKIEESLAFIRKSDELLXXXW

SEQ ID NO: 1932 - protein, 37 aa, Artificial Sequence
  Core polypeptide
  SITE 1, 2, 3, 34, 35, 36: Xaa = Aca (aminocaproic acid)
XXXGDEFDESISQVNEKIEESLAFIRKSDELLGXXXW

SEQ ID NO: 1933 - protein, 35 aa, Artificial Sequence
  Core polypeptide
  SITE 2: Xaa = Nal (napthylalanine)
VXPSDEYDASISQVNEEINQALAYIRKADELLENV

SEQ ID NO: 1934 - protein, 35 aa, Artificial Sequence
  Core polypeptide
  SITE 2, 7: Xaa = Nal (napthylalanine)
VXPSDEXDASISQVNEEINQALAYIRKADELLENV

SEQ ID NO: 1935 - protein, 35 aa, Artificial Sequence
  Core polypeptide
  SITE 2, 24: Xaa = Nal (napthylalanine)
VXPSDEYDASISQVNEEINQALAXIRKADELLENV

SEQ ID NO: 1936 - protein, 36 aa, Artificial Sequence; identical to SEQ ID NO: 1025
  Core polypeptide

SEQ ID NO: 1937 - protein, 28 aa, Artificial Sequence
  Core polypeptide
  SITE 1, 2, 3, 25, 26, 27: Xaa = Aua (11-aminoundecanoic acid)
XXXTALLEQAQIQQEKNEYELQKLXXXW

SEQ ID NO: 1938 - protein, 36 aa, Artificial Sequence
  Core polypeptide
WQAAEQKVRYLEANITALLEQAQIQQEKNEYELQKL

SEQ ID NO: 1939 - protein, 36 aa, Artificial Sequence
  Core polypeptide
WQEWEAAVRYLEANITALLEQAQIQQEKNEYELQKL

SEQ ID NO: 1940 - protein, 36 aa, Artificial Sequence
  Core polypeptide
WQEWEQAARYLEANITALLEQAQIQQEKNEYELQKL

SEQ ID NO: 1941 - protein, 36 aa, Artificial Sequence; identical to SEQ ID NO: 1033
  Core polypeptide

SEQ ID NO: 1942 - protein, 36 aa, Artificial Sequence; identical to SEQ ID NO: 1034
  Core polypeptide

SEQ ID NO: 1943 - protein, 47 aa, Artificial Sequence
  Core polypeptide
WQEWEQKVRYLEANITALLEQAQIQQEKNEYELQKLGGGGWASLWNF

SEQ ID NO: 1944 - protein, 39 aa, Artificial Sequence
  Core polypeptide
  SITE 6, 35: Xaa = Aca (aminocaproic acid)
GWNWFXDEFDESISQVQEEIEESLAFIEESDELLXWNWF

SEQ ID NO: 1945 - protein, 38 aa, Artificial Sequence
  Core polypeptide
  SITE 5, 34: Xaa = Aca (aminocaproic acid)
WNWFXDEFDESISQVNEKIEESLAFIRKSDELLXWNWF

SEQ ID NO: 1946 - protein, 38 aa, Artificial Sequence
  Core polypeptide
  SITE 5, 34: Xaa = Aca (aminocaproic acid)
WNWFXDEFDESISQVNEKIEESLAFIEESDELLXWNWF

SEQ ID NO: 1947 - protein, 35 aa, Artificial Sequence; identical to SEQ ID NO: 1099
  Core polypeptide

SEQ ID NO: 1948 - protein, 35 aa, Artificial Sequence; identical to SEQ ID NO: 1156
  Core polypeptide

SEQ ID NO: 1949 - protein, 35 aa, Artificial Sequence
  Core polypeptide
  SITE 11: Xaa = U (Aminobutyric Acid)
LSTTQWQVLPXSFTTLPALSTGLIHLHQNIVDVQY

SEQ ID NO: 1950 - protein, 33 aa, Artificial Sequence
  Core polypeptide
  SITE 12, 22: Xaa = U (Aminobutyric Acid)
FRKFPEATFSRXGSGPRITPRXMVDFPFRLWHY

SEQ ID NO: 1951 - protein, 39 aa, Artificial Sequence
  Core polypeptide
  SITE 11, 35: Xaa = U (Aminobutyric Acid)
DFPFRLWHFPXTINYTIFKVRLFVGGVEHRLEAAXNWTR

SEQ ID NO: 1952 - protein, 34 aa, Artificial Sequence
  Core polypeptide
  SITE 13, 21: Xaa = U (Aminobutyric Acid)
YVGGVEHRLEAAXNWTRGERXDLEDRDRSELSPL

SEQ ID NO: 1953 - protein, 27 aa, Artificial Sequence
  Core polypeptide
  SITE 3, 17, 24: Xaa = Any Amino Acid
YTXLIHSLIWESQNQQXKNEQELXELD

SEQ ID NO: 1954 - protein, 39 aa, Artificial Sequence
  Core polypeptide
  SITE 6, 13, 20, 27: Xaa = Any Amino Acid
WQEQEXKITALLXQAQIQQXKNEYELXKLDKWASLWEWF

SEQ ID NO: 1955 - protein, 30 aa, Artificial Sequence
  Core polypeptide
  SITE 6, 13, 20, 27: Xaa = Any Amino Acid
WQEWWXKITALLXQAQIQQXKNEYELXKLD

SEQ ID NO: 1956 - protein, 27 aa, Artificial Sequence
  Core polypeptide
  SITE 3, 10, 17, 24: Xaa = Any Amino Acid
WEXKITALLXQAQIQQXKNEYELXKLD

SEQ ID NO: 1957 - protein, 35 aa, Artificial Sequence
  Core polypeptide
STNKAVVSLSNGVSVGTSKVLDLKNYIDKQLLPIV

SEQ ID NO: 1958 - protein, 35 aa, Artificial Sequence
  Core polypeptide
  SITE 35: Xaa = U (Aminobutyric Acid)
VVSLSNGVSVLTSKVDLKNYIDKQWLLPIVNKQSX

SEQ ID NO: 1959 - protein, 35 aa, Artificial Sequence
  Core polypeptide
  SITE 34: Xaa = U (Aminobutyric Acid)
VSLSNGVSVLTSKVLDLKNYIDKQLLPIVNKQSXS

SEQ ID NO: 1960 - protein, 35 aa, Artificial Sequence
  Core polypeptide
  SITE 33: Xaa = U (Aminobutyric Acid)
SLSNGVSVLTSKVLDLKNYIDKQLLPIVNKQSXSI

SEQ ID NO: 1961 - protein, 36 aa, Artificial Sequence
  Core polypeptide
  SITE 33: Xaa = U (Aminobutyric Acid)
LSNGVSVLTSKVLDKLKNYIDKQLLPIVNKQSXSIS

SEQ ID NO: 1962 - protein, 35 aa, Artificial Sequence
  Core polypeptide
  SITE 31: Xaa = U (Aminobutyric Acid)
SNGVSVLTSKVLDLKNYIDKQLLPIVNKQSXSISN

SEQ ID NO: 1963 - protein, 35 aa, Artificial Sequence
  Core polypeptide
  SITE 30: Xaa = U (Aminobutyric Acid)
NGVSVLTSKVLDLKNYIDKQLLPIVNKQSXSISNI

SEQ ID NO: 1964 - protein, 35 aa, Artificial Sequence
  Core polypeptide
  SITE 29: Xaa = U (Aminobutyric Acid)
GVSVLTSKVLDLKNYIDKQLLPIVNKQSXSISNIE

SEQ ID NO: 1965 - protein, 36 aa, Artificial Sequence
  Core polypeptide
  SITE 28: Xaa = U (Aminobutyric Acid)
VSVLTSKVLDLKNYIDKQLLPIVNKQSXSISINIET

SEQ ID NO: 1966 - protein, 35 aa, Artificial Sequence
  Core polypeptide
  SITE 27: Xaa = U (Aminobutyric Acid)
SVLTSKVLDLKNYIDKQLLPIVNKQSXSISNIETV

SEQ ID NO: 1967 - protein, 35 aa, Artificial Sequence
  Core polypeptide
  SITE 26: Xaa = U (Aminobutyric Acid)
VLTSKVLDLKNYIDKQLLPIVNKQSXSISNIETVI

SEQ ID NO: 1968 - protein, 35 aa, Artificial Sequence
  Core polypeptide
  SITE 25: Xaa = U (Aminobutyric Acid)
LTSKVLDLKNYIDKQLLPIVNKQSXSISNIETVIE

SEQ ID NO: 1969 - protein, 34 aa, Artificial Sequence
  Core polypeptide
  SITE 23: Xaa = U (Aminobutyric Acid)
TSKVLDLKNYIDKQLLPIVKQSXSISNIETVIEF

SEQ ID NO: 1970 - protein, 35 aa, Artificial Sequence
  Core polypeptide
  SITE 23: Xaa = U (Aminobutyric Acid)
SKVLDLKNYIDKQLLPIVNKQSXSISNIETVIEFQ

SEQ ID NO: 1971 - protein, 35 aa, Artificial Sequence
  Core polypeptide
  SITE 22: Xaa = U (Aminobutyric Acid)
KVLDLKNYIDKQLLPIVNKQSXSISNIETVIEFQQ

SEQ ID NO: 1972 - protein, 35 aa, Artificial Sequence
  Core polypeptide
  SITE 21: Xaa = U (Aminobutyric Acid)
VLDLKNYIDKQLLPIVNKQSXSISNIETVIEFQQK

SEQ ID NO: 1973 - protein, 35 aa, Artificial Sequence
  Core polypeptide
  SITE 20: Xaa = U (Aminobutyric Acid)
LDLKNYIDKQLLPIVNKQSXSISNIETVIEFQQKN

SEQ ID NO: 1974 - protein, 35 aa, Artificial Sequence
  Core polypeptide
  SITE 19: Xaa = U (Aminobutyric Acid)
DLKNYIDKQLLPIVNKQSXSISNIETVIEFQQKNN

SEQ ID NO: 1975 - protein, 35 aa, Artificial Sequence
  Core polypeptide
  SITE 18: Xaa = U (Aminobutyric Acid)
LKNYIDKQLLPIVNKQSXSISNIETVIEFQQKNNR

SEQ ID NO: 1976 - protein, 35 aa, Artificial Sequence
  Core polypeptide
  SITE 17: Xaa = U (Aminobutyric Acid)
KNYIDKQLLPIVNKQSXSISNIETVIEFQQKNNRL

SEQ ID NO: 1977 - protein, 35 aa, Artificial Sequence
  Core polypeptide
  SITE 16: Xaa = U (Aminobutyric Acid)
NYIDKQLLPIVNKQSXSISNIETVIEFQQKNNRLL

SEQ ID NO: 1978 - protein, 35 aa, Artificial Sequence
  Core polypeptide
  SITE 15: Xaa = U (Aminobutyric Acid)
YIDKQLLPIVNKQSXSISNIETVIEFQQKNNRLLE

SEQ ID NO: 1979 - protein, 35 aa, Artificial Sequence
  Core polypeptide
  SITE 14: Xaa = U (Aminobutyric Acid)
IDKQLLPIVNKQSXSISNIETVIEFQQKNNRLLEI

SEQ ID NO: 1980 - protein, 35 aa, Artificial Sequence
  Core polypeptide
  SITE 13: Xaa = U (Aminobutyric Acid)
DKQLLPIVNKQSXSISNIETVIEFQQKNNRLLEIT

SEQ ID NO: 1981 - protein, 35 aa, Artificial Sequence
  Core polypeptide
  SITE 12: Xaa = U (Aminobutyric Acid)
KQLLPIVNKQSXSISNIETVIEFQQKNNRLLEITR

SEQ ID NO: 1982 - protein, 35 aa, Artificial Sequence
  Core polypeptide
  SITE 11: Xaa = U (Aminobutyric Acid)
QLLPIVNKQSXSISNIETVIEFQQKNNRLLEITRE

SEQ ID NO: 1983 - protein, 35 aa, Artificial Sequence
  Core polypeptide
  SITE 4: Xaa = Abu (aminobutyric acid)
DDEXLNSVKNGTYDFPKFEEESKLNRNEIKGVKLS

SEQ ID NO: 1984 - protein, 40 aa, Artificial Sequence; identical to SEQ ID NO: 1242
  Core polypeptide

SEQ ID NO: 1985 - protein, 40 aa, Artificial Sequence
  Core polypeptide
  SITE 4, 8: Xaa = Abu (aminobutyric acid)
YHKXDDEXLNSVKNGTFDFPKFEEESKLNRNEIKGVKLSS

SEQ ID NO: 1986 - protein, 36 aa, Artificial Sequence
  Core polypeptide
YTSLIHSLIEESQIQQEKNEQELLELDKWASLWNWF

SEQ ID NO: 1987 - protein, 36 aa, Artificial Sequence
  Core polypeptide
YTSLIHSLIEESQNQQEKNEYELLELDKWASLWNWF

SEQ ID NO: 1988 - protein, 36 aa, Artificial Sequence
  Core polypeptide
YTSLIHSLIEESQIQQEKNEYELLELDKWASLWNWF

SEQ ID NO: 1989 - protein, 36 aa, Artificial Sequence; identical to SEQ ID NO: 1252
  Core polypeptide

SEQ ID NO: 1990 - protein, 35 aa, Artificial Sequence
  Core polypeptide
WQEQEQKITALLEQAQIQQEKNEYELQKLDKEWWF

SEQ ID NO: 1991 - protein, 35 aa, Artificial Sequence
  Core polypeptide
WQEWEQKITALLEQAQIQQEKGEYELQKLDWQWEF

SEQ ID NO: 1992 - protein, 35 aa, Artificial Sequence
  Core polypeptide
WEQWEQKITALLEQAQIQQEKNEYELLELDKWEWF

SEQ ID NO: 1993 - protein, 40 aa, Artificial Sequence
  Core polypeptide
WQEWEQKITALLEQAQIQQEKNEYELEEELIEWASLWEWF

SEQ ID NO: 1994 - protein, 30 aa, Artificial Sequence
  Core polypeptide
WQEWQAQIQQEKNEYELQKLDKWASLWEWF

What is claimed is:

1. An isolated peptide having a formula selected from the group consisting of:
   X-VLHLEGEVNKIKSALLSTNKAVVSLSNGVSVLT SKVLDLKNYI-Z;
   X-VLHLEGEVNKIKSALLSTNKAVVSLSNGVSVLT SKVLDLKNYID-Z;
   X-VLHLEGEVNKIKSALLSTNKAVVSLSNGVSVLT SKVLDLKNYIDK-Z;
   X-VLHLEGEVNKIKSALLSTNKAVVSLSNGVSVLT SKVLDLKNYIDKQ-Z;
   X-SKVLHLEGEVNKIKSALLSTNKAVVSLSNGVSV LTSKVLDLKNYIDKQ-Z;
   X-AVSKVLHLEGEVNKIKSALLSTNKAVVSLSNGV SVLTSKVLDLKNYIDKQ-Z;
   X-AVSKVLHLEGEVNKIKSALLSTNKAVVSLSNGV SVLTSKVLDLKNYIDKQL-Z; and
   X-SGVAVSKVLHLEGEVNKIKSALLSTNKAVVSLS NGVSVLTSKVLDLKNYIDKQL-Z (SEQ ID NOS: 1549, 1548, 1545, 1544, 1546, 1551, 1547, and 1550, respectively),
      in which amino acid residues are presented by the single-letter code;
      X comprises an amino group, an acetyl group, a 9-fluorenylmethoxy-carbonyl group, a hydrophobic group, or a macromolecular carrier group;
      Z comprises a carboxyl group, an amido group, a hydrophobic group, or a macromolecular carrier group.

2. The isolated peptide of claim 1, wherein said peptide has the formula X-VLHLEGEVNKIKSALLSTNKAVVS LSNGVSVLTSKVLDLKNYI-Z (SEQ ID NO:1549).

3. The isolated peptide of claim 1, wherein said peptide has the formula X-VLHLEGEVNKIKSALLSTNKAVVSL SNGVSVLTSKVLDLKNYID-Z (SEQ ID NO:1548).

4. The isolated peptide of claim 1, wherein said peptide has the formula X-VLHLEGEVNKIKSALLSTNKAVV SLSNGVSVLTSKVLDLKNYIDK-Z (SEQ ID NO:1545).

5. The isolated peptide of claim 1, wherein said peptide has the formula X-VLHLEGEVNKIKSALLSTNKAVVSL SNGVSVLTSKVLDLKNYIDKQ-Z (SEQ ID NO:1544).

6. The isolated peptide of claim 1, wherein said peptide has the formula X-SKVLHLEGEVNKIKSALLSTNK AVVSLSNGVSVLTSKVLDLKNYIDKQ-Z (SEQ ID NO:1546).

7. The isolated peptide of claim 1, wherein said peptide has the formula X-AVSKVLHLEGEVNKIKSALLSTNKA VVSLSNGVSVLTSKVLDLKNYIDKQ-Z (SEQ ID NO:1551).

8. The isolated peptide of claim 1, wherein said peptide has the formula X-AVSKVLHLEGEVNKIKSALLSTNKA VVSLSNGVSVLTSKVLDLKNYIDKQL-Z (SEQ ID NO:1547).

9. The isolated peptide of claim 1, wherein said peptide has the formula X-SGVAVSKVLHLEGEVNKIKSALLST NKAVVSLSNGVSVLTSKVLDLKNYIDKQL-Z (SEQ ID NO:1550).

10. The isolated peptide of claim 1, wherein X comprises an amino group, an acetyl group, a 9-fluorenylmethoxy-carbonyl group, a hydrophobic group or a macromolecular carrier group; further wherein Z is an amido group.

11. The isolated peptide of claim 1, wherein Z comprises a carboxyl group, an amido group, a hydrophobic group or a macromolecular carrier group; further wherein X is an acetyl group.

12. The isolated peptide of claim 1, wherein X is an acetyl group, and Z is an amido group.

* * * * *